US012742170B2

(12) United States Patent
Mullick et al.

(10) Patent No.: US 12,742,170 B2
(45) Date of Patent: Sep. 22, 2026

(54) COMPOUNDS AND METHODS FOR REDUCING PLN EXPRESSION

(71) Applicant: IONIS PHARMACEUTICALS, INC., Carlsbad, CA (US)

(72) Inventors: Adam Mullick, Carlsbad, CA (US); Huynh-Hoa Bui, Carlsbad, CA (US); Susan M. Freier, Carlsbad, CA (US); Ting Yuan Yeh, Carlsbad, CA (US); Dieter Kubli, Carlsbad, CA (US)

(73) Assignee: IONIS PHARMACEUTICALS INC., Carlsbad, CA (US)

( * ) Notice: Subject to any disclaimer, the term of this patent is extended or adjusted under 35 U.S.C. 154(b) by 609 days.

(21) Appl. No.: 18/546,054

(22) PCT Filed: Feb. 10, 2022

(86) PCT No.: PCT/US2022/016015

§ 371 (c)(1),
(2) Date: Aug. 10, 2023

(87) PCT Pub. No.: WO2022/173976

PCT Pub. Date: Aug. 18, 2022

(65) Prior Publication Data

US 2024/0191232 A1 Jun. 13, 2024

Related U.S. Application Data

(60) Provisional application No. 63/148,579, filed on Feb. 11, 2021.

(51) Int. Cl.

| | |
|---|---|
| ***C12N 15/113*** | (2010.01) |
| ***A61P 9/10*** | (2006.01) |
| ***C07K 14/705*** | (2006.01) |
| ***C07K 16/28*** | (2006.01) |
| ***C12N 9/22*** | (2006.01) |
| ***C12N 15/115*** | (2010.01) |

(52) U.S. Cl.

CPC .............. *C12N 15/113* (2013.01); *A61P 9/10* (2018.01); *C07K 14/70582* (2013.01); *C07K 16/2881* (2013.01); *C12N 9/22* (2013.01); *C12N 15/115* (2013.01); *C12N 2310/14* (2013.01); *C12N 2310/314* (2013.01); *C12N 2310/315* (2013.01); *C12N 2310/321* (2013.01); *C12N 2310/322* (2013.01); *C12N 2310/3341* (2013.01); *C12N 2310/3525* (2013.01); *C12Y 301/26004* (2013.01)

(58) Field of Classification Search

None

See application file for complete search history.

(56) References Cited

U.S. PATENT DOCUMENTS

| | | | |
|---|---|---|---|
| 3,687,808 | A | 8/1972 | Merigan, Jr. et al. |
| 4,415,732 | A | 11/1983 | Caruthers et al. |
| 4,469,863 | A | 9/1984 | Ts'o et al. |
| 4,476,301 | A | 10/1984 | Imbach et al. |
| 4,500,707 | A | 2/1985 | Caruthers et al. |
| 4,725,677 | A | 2/1988 | Koster et al. |
| 4,845,205 | A | 7/1989 | Huynh Dinh et al. |
| 4,973,679 | A | 11/1990 | Caruthers et al. |
| 4,981,957 | A | 1/1991 | Lebleu et al. |
| 5,013,830 | A | 5/1991 | Ohtsuka et al. |
| 5,023,243 | A | 6/1991 | Tullis |
| 5,034,506 | A | 7/1991 | Summerton et al. |
| 5,118,800 | A | 6/1992 | Smith et al. |
| 5,130,302 | A | 7/1992 | Spielvogel et al. |
| 5,132,418 | A | 7/1992 | Caruthers et al. |
| 5,134,066 | A | 7/1992 | Rogers et al. |
| 5,149,797 | A | 9/1992 | Pederson et al. |
| 5,166,315 | A | 11/1992 | Summerton et al. |
| 5,175,273 | A | 12/1992 | Bischofberger et al. |
| 5,177,196 | A | 1/1993 | Meyer, Jr. et al. |
| 5,177,198 | A | 1/1993 | Spielvogel et al. |
| 5,185,444 | A | 2/1993 | Summerton et al. |
| 5,188,897 | A | 2/1993 | Suhadolnik et al. |
| 5,194,599 | A | 3/1993 | Froehler et al. |
| 5,214,134 | A | 5/1993 | Weis et al. |
| 5,216,141 | A | 6/1993 | Benner |
| 5,220,007 | A | 6/1993 | Pederson et al. |
| 5,223,618 | A | 6/1993 | Cook et al. |
| 5,235,033 | A | 8/1993 | Summerton et al. |
| 5,256,775 | A | 10/1993 | Froehler |
| 5,264,423 | A | 11/1993 | Cohen et al. |

(Continued)

FOREIGN PATENT DOCUMENTS

| | | |
|---|---|---|
| EP | 1126866 B1 | 2/2007 |
| EP | 1939289 A1 | 7/2008 |

(Continued)

OTHER PUBLICATIONS

Fechner, H., et. al., Gene Therapy, vol. 14, p. 211-218, Oct. 5, 2006 (Year: 2006).*

He, H., et. al., Circulation, vol. 100, No. 9, p. 974-980, Aug. 31, 1999 (Year: 1999).*

Hu, B., et. al., Signal Transduction and Targeted Therapy, vol. 5, No. 101, p. 1-25, Jun. 19, 2020 (Year: 2020).*

Sabatino, D. and Damha, M., Journal of the American Chemical Society, vol. 129, No. 26, p. 8259-8270, Jul. 4, 2007 (Year: 2007).*

(Continued)

*Primary Examiner* — Neil P Hammell
*Assistant Examiner* — Krishna N Ravindra

(57) ABSTRACT

Provided are oligomeric agents, oligomeric compounds, methods, and pharmaceutical compositions for reducing the amount or activity of PLN RNA in a cell or animal, and in certain instances reducing the amount of PLN protein in a cell or animal. Such oligomeric agents, oligomeric compounds, methods, and pharmaceutical compositions are useful to treat cardiomyopathy, heart failure, or arrhythmia.

19 Claims, No Drawings

Specification includes a Sequence Listing.

(56) References Cited

U.S. PATENT DOCUMENTS

| | | | |
|---|---|---|---|
| 5,264,562 | A | 11/1993 | Matteucci |
| 5,264,564 | A | 11/1993 | Matteucci |
| 5,276,019 | A | 1/1994 | Cohen et al. |
| 5,286,717 | A | 2/1994 | Cohen et al. |
| 5,319,080 | A | 6/1994 | Leumann |
| 5,321,131 | A | 6/1994 | Agrawal et al. |
| 5,359,044 | A | 10/1994 | Cook et al. |
| 5,366,878 | A | 11/1994 | Pederson et al. |
| 5,367,066 | A | 11/1994 | Urdea et al. |
| 5,378,825 | A | 1/1995 | Cook et al. |
| 5,386,023 | A | 1/1995 | Sanghvi et al. |
| 5,393,878 | A | 2/1995 | Leumann |
| 5,399,676 | A | 3/1995 | Froehler |
| 5,403,711 | A | 4/1995 | Walder et al. |
| 5,405,938 | A | 4/1995 | Summerton et al. |
| 5,405,939 | A | 4/1995 | Suhadolnik et al. |
| 5,432,272 | A | 7/1995 | Benner |
| 5,434,257 | A | 7/1995 | Matteucci et al. |
| 5,446,137 | A | 8/1995 | Maag et al. |
| 5,453,496 | A | 9/1995 | Caruthers et al. |
| 5,455,233 | A | 10/1995 | Spielvogel et al. |
| 5,457,187 | A | 10/1995 | Gmeiner et al. |
| 5,457,191 | A | 10/1995 | Cook et al. |
| 5,459,255 | A | 10/1995 | Cook et al. |
| 5,466,677 | A | 11/1995 | Baxter et al. |
| 5,466,786 | A | 11/1995 | Buhr et al. |
| 5,470,967 | A | 11/1995 | Huie et al. |
| 5,476,925 | A | 12/1995 | Letsinger et al. |
| 5,484,908 | A | 1/1996 | Froehler et al. |
| 5,489,677 | A | 2/1996 | Sanghvi et al. |
| 5,491,133 | A | 2/1996 | Walder et al. |
| 5,502,177 | A | 3/1996 | Matteucci et al. |
| 5,508,270 | A | 4/1996 | Baxter et al. |
| 5,514,785 | A | 5/1996 | Van Ness et al. |
| 5,519,126 | A | 5/1996 | Hecht |
| 5,519,134 | A | 5/1996 | Acevedo et al. |
| 5,525,711 | A | 6/1996 | Hawkins et al. |
| 5,527,899 | A | 6/1996 | Froehler |
| 5,536,821 | A | 7/1996 | Agrawal et al. |
| 5,539,082 | A | 7/1996 | Nielsen et al. |
| 5,541,306 | A | 7/1996 | Agrawal et al. |
| 5,541,307 | A | 7/1996 | Cook et al. |
| 5,550,111 | A | 8/1996 | Suhadolnik et al. |
| 5,552,540 | A | 9/1996 | Haralambidis |
| 5,561,225 | A | 10/1996 | Maddry et al. |
| 5,563,253 | A | 10/1996 | Agrawal et al. |
| 5,565,350 | A | 10/1996 | Kmiec |
| 5,565,555 | A | 10/1996 | Froehler et al. |
| 5,567,811 | A | 10/1996 | Misiura et al. |
| 5,571,799 | A | 11/1996 | Tkachuk et al. |
| 5,576,427 | A | 11/1996 | Cook et al. |
| 5,587,361 | A | 12/1996 | Cook et al. |
| 5,587,469 | A | 12/1996 | Cook et al. |
| 5,587,470 | A | 12/1996 | Cook et al. |
| 5,591,722 | A | 1/1997 | Montgomery et al. |
| 5,594,121 | A | 1/1997 | Froehler et al. |
| 5,596,086 | A | 1/1997 | Matteucci et al. |
| 5,596,091 | A | 1/1997 | Switzer |
| 5,597,909 | A | 1/1997 | Urdea et al. |
| 5,602,240 | A | 2/1997 | De Mesmaeker et al. |
| 5,608,046 | A | 3/1997 | Cook et al. |
| 5,610,289 | A | 3/1997 | Cook et al. |
| 5,610,300 | A | 3/1997 | Altmann et al. |
| 5,614,617 | A | 3/1997 | Cook et al. |
| 5,618,704 | A | 4/1997 | Sanghvi et al. |
| 5,623,065 | A | 4/1997 | Cook et al. |
| 5,623,070 | A | 4/1997 | Cook et al. |
| 5,625,050 | A | 4/1997 | Beaton et al. |
| 5,627,053 | A | 5/1997 | Usman et al. |
| 5,633,360 | A | 5/1997 | Bischofberger et al. |
| 5,639,873 | A | 6/1997 | Barascut et al. |
| 5,645,985 | A | 7/1997 | Froehler et al. |
| 5,646,265 | A | 7/1997 | McGee |
| 5,646,269 | A | 7/1997 | Matteucci et al. |
| 5,652,355 | A | 7/1997 | Metelev et al. |
| 5,652,356 | A | 7/1997 | Agrawal |
| 5,663,312 | A | 9/1997 | Chaturvedula |
| 5,670,633 | A | 9/1997 | Cook et al. |
| 5,672,697 | A | 9/1997 | Buhr et al. |
| 5,677,437 | A | 10/1997 | Teng et al. |
| 5,677,439 | A | 10/1997 | Weis et al. |
| 5,681,941 | A | 10/1997 | Cook et al. |
| 5,698,685 | A | 12/1997 | Summerton et al. |
| 5,700,920 | A | 12/1997 | Altmann et al. |
| 5,700,922 | A | 12/1997 | Cook |
| 5,714,331 | A | 2/1998 | Buchardt et al. |
| 5,719,262 | A | 2/1998 | Buchardt et al. |
| 5,721,218 | A | 2/1998 | Froehler |
| 5,750,692 | A | 5/1998 | Cook et al. |
| 5,763,588 | A | 6/1998 | Matteucci et al. |
| 5,792,608 | A | 8/1998 | Swaminathan et al. |
| 5,792,847 | A | 8/1998 | Buhr et al. |
| 5,801,154 | A | 9/1998 | Baracchini et al. |
| 5,808,027 | A | 9/1998 | Cook et al. |
| 5,811,534 | A | 9/1998 | Cook et al. |
| 5,830,653 | A | 11/1998 | Froehler et al. |
| 5,859,221 | A | 1/1999 | Cook et al. |
| 5,948,903 | A | 9/1999 | Cook et al. |
| 5,968,959 | A | 10/1999 | Haikala et al. |
| 5,994,517 | A | 11/1999 | Ts'o et al. |
| 6,005,087 | A | 12/1999 | Cook et al. |
| 6,005,096 | A | 12/1999 | Matteucci et al. |
| 6,166,199 | A | 12/2000 | Cook et al. |
| 6,265,421 | B1 | 7/2001 | Pystynen et al. |
| 6,268,490 | B1 | 7/2001 | Imanishi et al. |
| 6,300,319 | B1 | 10/2001 | Manoharan |
| 6,426,220 | B1 | 7/2002 | Bennett et al. |
| 6,525,191 | B1 | 2/2003 | Ramasamy |
| 6,531,584 | B1 | 3/2003 | Cook et al. |
| 6,582,908 | B2 | 6/2003 | Fodor et al. |
| 6,600,032 | B1 | 7/2003 | Manoharan et al. |
| 6,660,720 | B2 | 12/2003 | Manoharan |
| 6,670,461 | B1 | 12/2003 | Wengel et al. |
| 6,770,748 | B2 | 8/2004 | Imanishi et al. |
| 6,794,499 | B2 | 9/2004 | Wengel et al. |
| 7,015,315 | B1 | 3/2006 | Cook et al. |
| 7,034,133 | B2 | 4/2006 | Wengel et al. |
| 7,053,207 | B2 | 5/2006 | Wengel |
| 7,101,993 | B1 | 9/2006 | Cook et al. |
| 7,208,174 | B2 | 4/2007 | Huwyler et al. |
| 7,262,177 | B2 | 8/2007 | Ts'o et al. |
| 7,399,845 | B2 | 7/2008 | Seth et al. |
| 7,427,672 | B2 | 9/2008 | Imanishi et al. |
| 7,491,805 | B2 | 2/2009 | Vargeese et al. |
| 7,534,775 | B2 | 5/2009 | Zhang et al. |
| 7,547,684 | B2 | 6/2009 | Seth et al. |
| 7,569,686 | B1 | 8/2009 | Bhat et al. |
| 7,666,854 | B2 | 2/2010 | Seth et al. |
| 7,696,345 | B2 | 4/2010 | Allerson et al. |
| 7,723,509 | B2 | 5/2010 | Manoharan et al. |
| 7,741,457 | B2 | 6/2010 | Seth et al. |
| 7,750,131 | B2 | 7/2010 | Seth et al. |
| 7,875,733 | B2 | 1/2011 | Bhat et al. |
| 7,939,677 | B2 | 5/2011 | Bhat et al. |
| 8,022,193 | B2 | 9/2011 | Seth et al. |
| 8,030,467 | B2 | 10/2011 | Seth et al. |
| 8,080,644 | B2 | 12/2011 | Wengel et al. |
| 8,084,598 | B1 | 12/2011 | Bentwich |
| 8,088,746 | B2 | 1/2012 | Seth et al. |
| 8,088,904 | B2 | 1/2012 | Swayze et al. |
| 8,106,022 | B2 | 1/2012 | Manoharan et al. |
| 8,124,745 | B2 | 2/2012 | Allerson et al. |
| 8,153,365 | B2 | 4/2012 | Wengel et al. |
| 8,178,503 | B2 | 5/2012 | Rigoutsos et al. |
| 8,207,138 | B2 | 6/2012 | Thakker et al. |
| 8,268,980 | B2 | 9/2012 | Seth et al. |
| 8,273,866 | B2 | 9/2012 | McSwiggen et al. |
| 8,278,283 | B2 | 10/2012 | Seth et al. |
| 8,278,425 | B2 | 10/2012 | Prakash et al. |
| 8,278,426 | B2 | 10/2012 | Seth et al. |
| 8,314,227 | B2 | 11/2012 | Wengel |
| 8,404,658 | B2 | 3/2013 | Hajjar et al. |
| 8,440,803 | B2 | 5/2013 | Swayze et al. |
| 8,501,805 | B2 | 8/2013 | Seth et al. |

(56) References Cited

U.S. PATENT DOCUMENTS

| | | | |
|---|---|---|---|
| 8,530,640 | B2 | 9/2013 | Seth et al. |
| 8,546,556 | B2 | 10/2013 | Seth et al. |
| RE44,779 | E | 2/2014 | Imanishi et al. |
| 8,796,437 | B2 | 8/2014 | Swayze et al. |
| 8,828,956 | B2 | 9/2014 | Manoharan et al. |
| 9,005,906 | B2 | 4/2015 | Swayze et al. |
| 9,012,421 | B2 | 4/2015 | Migawa et al. |
| 9,034,329 | B2 | 5/2015 | Chang et al. |
| 9,127,276 | B2 | 9/2015 | Prakash et al. |
| 9,290,760 | B2 | 3/2016 | Rajeev et al. |
| 9,745,586 | B2 | 8/2017 | Bowser et al. |
| 10,138,483 | B2 | 11/2018 | Chatterton et al. |
| 10,550,188 | B2 | 2/2020 | Geall et al. |
| 10,759,864 | B2 | 9/2020 | Sonoda et al. |
| 2001/0053519 | A1 | 12/2001 | Fodor et al. |
| 2002/0040010 | A1 | 4/2002 | Rosenzweig et al. |
| 2003/0050259 | A1 | 3/2003 | Blatt et al. |
| 2003/0158403 | A1 | 8/2003 | Manoharan et al. |
| 2003/0175906 | A1 | 9/2003 | Manoharan et al. |
| 2003/0228597 | A1 | 12/2003 | Cowsert et al. |
| 2004/0121942 | A1 | 6/2004 | Chien et al. |
| 2004/0171570 | A1 | 9/2004 | Allerson et al. |
| 2005/0095227 | A1 | 5/2005 | Rosenzweig et al. |
| 2005/0130923 | A1 | 6/2005 | Bhat et al. |
| 2005/0288244 | A1 | 12/2005 | Manoharan et al. |
| 2006/0148740 | A1 | 7/2006 | Platenburg |
| 2006/0198825 | A1 | 9/2006 | Kaemmerer et al. |
| 2007/0031844 | A1 | 2/2007 | Khvorova et al. |
| 2008/0039618 | A1 | 2/2008 | Allerson et al. |
| 2008/0113351 | A1 | 5/2008 | Naito et al. |
| 2010/0190837 | A1 | 7/2010 | Migawa et al. |
| 2010/0197762 | A1 | 8/2010 | Swayze |
| 2010/0298697 | A1 | 11/2010 | Thakker et al. |
| 2010/0310521 | A1 | 12/2010 | Fechner et al. |
| 2011/0078833 | A1 | 3/2011 | Wu et al. |
| 2011/0098338 | A1 | 4/2011 | Hajjar et al. |
| 2013/0096289 | A1 | 4/2013 | Wengel |
| 2013/0130378 | A1 | 5/2013 | Manoharan et al. |
| 2013/0190383 | A1 | 7/2013 | Vaish et al. |
| 2013/0203836 | A1 | 8/2013 | Rajeev et al. |
| 2014/0107330 | A1 | 4/2014 | Freier et al. |
| 2015/0018540 | A1 | 1/2015 | Prakash et al. |
| 2015/0184153 | A1 | 7/2015 | Freier et al. |
| 2015/0191727 | A1 | 7/2015 | Migawa et al. |
| 2015/0267195 | A1 | 9/2015 | Seth et al. |
| 2015/0275212 | A1 | 10/2015 | Albaek et al. |
| 2017/0204407 | A1 | 7/2017 | Gilbert et al. |
| 2019/0240346 | A1 | 8/2019 | Sugo et al. |
| 2021/0038739 | A1 | 2/2021 | Takahashi et al. |

FOREIGN PATENT DOCUMENTS

| | | | |
|---|---|---|---|
| EP | 2126084 | B1 | 3/2014 |
| WO | 9104753 | A1 | 4/1991 |
| WO | 9900132 | A1 | 1/1999 |
| WO | 9914226 | A2 | 3/1999 |
| WO | 9915523 | A1 | 4/1999 |
| WO | 0116312 | A2 | 3/2001 |
| WO | 03070918 | A2 | 8/2003 |
| WO | 2004045543 | A2 | 6/2004 |
| WO | 2004106356 | A1 | 12/2004 |
| WO | 2005100393 | A1 | 10/2005 |
| WO | 2005116204 | A1 | 12/2005 |
| WO | 2007134181 | A2 | 11/2007 |
| WO | 2008080985 | A1 | 7/2008 |
| WO | 2008101157 | A1 | 8/2008 |
| WO | 2009088786 | A1 | 7/2009 |
| WO | 2009120878 | A2 | 10/2009 |
| WO | 2009142822 | A9 | 1/2010 |
| WO | 2010135322 | A1 | 11/2010 |
| WO | 2011133876 | A2 | 10/2011 |
| WO | 2013036868 | A1 | 3/2013 |
| WO | 2013103800 | A1 | 7/2013 |
| WO | 2013163303 | A2 | 10/2013 |
| WO | 2013173637 | A1 | 11/2013 |
| WO | 2014144060 | A1 | 9/2014 |
| WO | 2014179620 | A1 | 11/2014 |
| WO | 2015106128 | A2 | 7/2015 |
| WO | 2016081643 | A1 | 5/2016 |
| WO | 2016179257 | A2 | 11/2016 |
| WO | 2016207240 | A1 | 12/2016 |
| WO | 2017015555 | A1 | 1/2017 |
| WO | 2018098328 | A1 | 5/2018 |
| WO | 2018129384 | A1 | 7/2018 |
| WO | 2018154439 | A1 | 8/2018 |
| WO | 2019033051 | A1 | 2/2019 |
| WO | 2019140050 | A1 | 7/2019 |
| WO | 2019157531 | A1 | 8/2019 |
| WO | 2020028864 | A1 | 2/2020 |
| WO | 2020037150 | A2 | 2/2020 |
| WO | 2020124032 | A1 | 6/2020 |
| WO | 2020132584 | A1 | 6/2020 |
| WO | 2020191171 | A1 | 9/2020 |
| WO | 2020245198 | A1 | 12/2020 |
| WO | 2021030778 | A1 | 2/2021 |

OTHER PUBLICATIONS

Allerson C.R., et al., "Fully 2'-Modified Oligonucleotide Duplexes with Improved in Vitro Potency and Stability Compared to Unmodified Small Interfering RNA", Journal of medicinal chemistry , Jan. 20, 2005, vol. 48, No. 4, pp. 901-904.

Janas M.M., et al., "Safety Evaluation of 2'-deoxy-2'-fluoro Nucleotides in GalNAc-siRNA Conjugates", Nucleic Acids Research, Mar. 1, 2019, vol. 47, No. 7, pp. 3306-3320.

Shen W., et al., "Acute Hepatotoxicity of 2' Fluoro-modified 5-10-5 Gapmer Phosphorothioate Oligonucleotides in Mice Correlates with Intracellular Protein Binding and the Loss of DBHS Proteins", Nucleic acids research, Jan. 30, 2018, vol. 46, No. 5, pp. 2204-2217.

Supplementary Partial European Search Report in European Patent Application No. 22753363.5, dated Nov. 22, 2024, 14 Pages.

Andino L.M., et al., "AAV-mediated Knockdown of Phospholamban Leads to Improved Contractility and Calcium Handling in Cardiomyocytes", The Journal of Gene Medicine, Feb. 2008, vol. 10, No. 2, pp. 132-142.

Beverborg N.G., et al., "Phospholamban Antisense Oligonucleotides Improve Cardiac Function in Murine Cardiomyopathy", Nature Communication, Aug. 30, 2021, vol. 12, 15 Pages.

Bicycle Therapeutics: "Bicycles, Bi-cyclic Peptides, Novel Small Molecule Delivery Systems for RNA Therapeutics", Presentation for Euro TIDES, Nov. 19, 2021, 20 Pages.

Branch A.D., "A Good Antisense Molecule is Hard to Find," TIBS, Feb. 1998, vol. 23, No. 2, pp. 45-50.

Chin A., "On the Preparation and Utilization of Isolated and Purified Oligonucleotides," Document Purportedly Located on A CD-ROM and Contributed to the Public Collection of the Katherine R. Everett Law Library of the University of North Carolina, Mar. 9, 2002, p. C18.

Crooke S T., "Antisense Drug Technology", Second Edition, CRC Press, 2008, Chapters 1-28, 414 Pages.

Crooke S.T., "Basic Principles of Antisense Therapeutics," Antisense Research and Application, Chapter 1, 1998, pp. 1-50.

Crooke S.T., et al., "Pharmacokinetic Properties of Several Novel Oligonucleotide Analogs in Mice," The Journal of Pharmacology and Experimental Therapeutics, 1996, vol. 277, No. 2, pp. 923-937.

Del Monte F., et al., "Targeting Phospholamban by Gene Transfer in Human Heart Failure", Circulation, Feb. 2002, vol. 105, No. 8, pp. 904-907.

Egli M., et al., "Synthesis, Improved Antisense Activity and Structural Rationale for the Divergent RNA Affinities of 3'-Fluoro Hexitol Nucleic Acid (FHNA and Ara-FHNA) Modified Oligonucleotides," Journal of the American Chemical Society, Oct. 19, 2011, vol. 133, No. 41, pp. 16642-16649, 21 Pages.

Eizema K., et al., "Adenovirus-based Phospholamban Antisense Expression As a Novel Approach to Improve Cardiac Contractile Dysfunction: Comparison of a Constitutive Viral Versus an Endothelin-1-responsive Cardiac Promoter", Circulation, May 9, 2000, vol. 101, No. 18, pp. 2193-2199.

(56) References Cited

OTHER PUBLICATIONS

Elmen J., et al., "Locked Nucleic Acid (LNA) Mediated Improvements in siRNA Stability and Functionality", Nucleic Acids Research, 2005, vol. 33, No. 1, pp. 439-447.

Frieden M., et al., "Expanding the Design Horizon of Antisense Oligonucleotides with Alpha-L-LNA," Nucleic Acids Research, 2003, vol. 31, No. 21, pp. 6365-6372.

Gautschi O., et al., "Activity of a Novel bcl-2/bcl-xL-Bispecific Antisense Oligonucleotide Against Tumors of Diverse Histologic Origins," Journal of the National Cancer Institute, Mar. 21, 2001, vol. 93, No. 6, pp. 463-471.

Grunweller A., et al., "Comparison of Different Antisense Strategies in Mammalian Cells Using Locked Nucleic Acids, 2'-O-methyl RNA, Phosphorothioates and Small Interfering RNA", Nucleic Acids Research, 2003, vol. 31, No. 12, pp. 3185-3193.

He H., et al., "Effects of Mutant and Antisense RNA of Phospholamban on SR Ca2+-ATPase Activity and Cardiac Myocyte Contractility", Circulation, Aug. 31, 1999, vol. 100, No. 9, pp. 974-980.

Hidalgo-Gonzalez A., et al., "Amelioration of Heart Failure in a Mouse Model of Dilated Cardiomyopathy Following Phospholamban (PLN) Anstisense Oligonucleotide Treatment", Poster for Heart Failure: Crossing the Translation Divide, Keystone, CO, Jan. 14-18, 2018, 1 Page.

International Search Report and Written Opinion for International Application No. PCT/US2022/016015, dated Jun. 29, 2022, 13 pages.

Kabanov A.V., et al., "A New Class of Antivirals: Antisense Oligonucleotides Combined with a Hydrophobic Substituent Effectively Inhibit Influenza Virus Reproduction and Synthesis of Virus-Specific Proteins in MDCK Cells," FEBS Letters, Jan. 1990, vol. 259, No. 2, pp. 327-330.

Karakikes I., et al., "Correction of Human Phospholamban R14del Mutation Associated with Cardiomyopathy Using Targeted Nucleases and Combination Therapy", Nature Communication, Apr. 2015, 10 Pages.

Koss K.L., et al., "Phospholamban: A Prominent Regulator of Myocardial Contractility", Circulation Research, Dec. 1996, vol. 79, pp. 1059-1063.

Letsinger R L., et al., "Cholesteryl-Conjugated Oligonucleotides: Synthesis, Properties, and Activity as Inhibitors of Replication of Human Immunodeficiency Virus in Cell Culture", Proc. Natl. Acad. Sci. USA, Sep. 1989, vol. 86, pp. 6553-6556.

Leumann C J., "DNA Analogues: From Supramolecular Principles to Biological Properties", Bioorganic Medicinal Chemistry, 2002, vol. 10, pp. 841-854.

Lorenz J.N., et al., "Regulatory Effects of Phospholamban on Cardian Function in Intact Mice", The American journal of physiology, Dec. 1997, vol. 273, pp. H2826-H2831.

Maher L.J., et al., "Comparative Hybrid Arrest By Tandem Antisense Oligodeoxyribonucleotides or Oligodeoxy-Ribonucleoside Methylpbosphonates in A Cell-Free System," Nucleic Acids Research, 1988, vol. 16, No. 8, pp. 3341-3358.

Manoharan M., et al., "Chemical Modifications to Improve Uptake and Bioavailability of Antisense Oligonucleotides," Annals of the New York Academy of Sciences, 1992, vol. 660, pp. 306-309.

Manoharan M., et al., "Cholic Acid-Oligonucleotide Conjugates for Antisense Applications," Bioorganic and Medicinal Chemistry Letters, 1994, vol. 4, No. 8, pp. 1053-1060.

Manoharan M., et al., "Introduction of a Lipophilic Thioether Tether in the Minor Groove of Nucleic Acids for Antisense Applications," Bioorganic and Medicinal Chemistry Letters, 1993, vol. 3, No. 12, pp. 2765-2770.

Manoharan M., et al., "Lipidic Nucleic Acids," Tetrahedron Letters, 1995, vol. 36, No. 21, pp. 3651-3654.

Manoharan M., et al., "Oligonucleotide Conjugates: Alteration of the Pharmacokinetic Properties of Antisense Agents," Nucleosides & Nucleotides, 1995, vol. 14, No. 3-5, pp. 969-973.

Minamisawa S., et al., "Chronic Phospholamban-Sarcoplasmic Reticulum Calcium ATPase Interaction Is the Critical Calcium Cycling Defect in Dilated Cardiomyopathy", Cell, Oct. 29, 1999, vol. 99, pp. 313-322.

Mishra R.K., et al., "Improved Leishmanicidal Effect of Phosphorotioate Antisense Oligonucleotides by LDL-Mediated Delivery," Biochimica et Biophysica Acta, 1995, vol. 1264, No. 2, pp. 229-237.

Mook O.R., et al., "Evaluation of Locked Nucleic Acid-modified Small Interfering RNA in Vitro and in Vivo", Molecular Cancer Therapeutics, Mar. 2007, vol. 6, No. 3, pp. 833-843.

Morihara H., et al., "Phospholamban Inhibition by a Single Dose of Locked Nucleic Acid Antisense Oligonucleotide Improves Cardiac Contractility in Pressure Overload-Induced Systolic Dysfunction in Mice", Journal of Cardiovascular Pharmacology and Therapeutics, May 2017, vol. 22, No. 3, pp. 273-282.

Mou Y., et al., "Partial Restoration of Left Ventricular Systolic Function by ASPLB Gene Transfer Using Ultrasound-mediated Microbubble Destruction", Ultrasound in Medicine Biology, Oct. 2009, vol. 35, No. 10, pp. 1638-1646.

Mullick A., "Antisense Oligonucleotides as Cardiovascular Therapeutics: Past, Present and Future", Presentation for AHA Scientific Sessions, Nov. 12, 2018, 16 Pages.

Mullick A., "Antisense Oligonucleotides as Cardiovascular Therapeutics: Past, Present and Future", Presentation for University of Kentucky College of Medicine, CVRC Cardiovascular Seminar Series, Feb. 14, 2020, 38 Pages.

Mullick A., et al., "Phospholamban Antisense Oligonucleotide Treatment Improved Cardiac Function and Reduced Transcriptional Markers of Heart Failure in a Mouse Model of Dilated Cardiomyopathy", Gordon Research Conference, New London, NH, Jun. 3-8, 2018, 1 Page.

Mullick A., et al., "Phospholamban Antisense Oligonucleotide Treatment Improved Cardiac Function and Reduced Transcriptional Markers of Heart Failure in a Mouse Model of Dilated Cardiomyopathy", Poster for Nature Conference: RNA athe Bench and Bedside, 2018, La Jolla, CA, Oct. 8-10, 1 Page.

Mullick A., "RNA Targeting Therapies for Heart Failure", Presentation for RNA at the Bench and Bedside Meeting, San Diego, CA, Nov. 12, 2020, 27 Pages.

Munker K., et al., "Effects of a Novel Phospholamban Inhibitor on Systolic, Diastolic and Mitochondrial Function in a Mouse Model of Dilated Cardiomyopathy", Clinical Research in Cardiology, Apr. 2019, vol. 108, Supplement 1, 1 Page.

New England Biolabs, Nucleic Acids, Linkers and Primers, 1998/1999, Catalog, 121 and 284.

Nishina K., et al., "Efficient In Vivo Delivery of siRNA to the Liver by Conjugation of α-Tocopherol", Molecular Therapy, vol. 16, No. 4, Apr. 2008, pp. 734-740.

Nishina T., et al., "Chimeric Antisense Oligonucleotide Conjugated to α-Tocopherol", Molecular Therapy Nucleic Acids, 2015, 4, e220, pp. 1-10.

Oberhauser B., et al., "Effective Incorporation of 2'-O-Methyl-Oligoribonucleotides into Liposomes and Enhanced Cell Association through Modification with Thiocholesterol," Nucleic Acids Research, 1992, vol. 20, No. 3, pp. 533-538.

Reynolds A., et al., "Rational siRNA Design for RNA Interference", Nature Biotechnology, Mar. 2004, vol. 22, No. 3, pp. 326-330.

Saison-Behmoaras T., et al., "Short Modified Antisense Oligonucleotides Directed Against Ha-ras Point Mutation Induce Selective Cleavage of the mRNA and Inhibit T24 Cells Proliferation," The EMBO Journal, 1991, vol. 10, No. 5, pp. 1111-1118.

Sanghvi Y.S., "Heterocyclic Base Modifications in Nucleic Acids and Their Applications in Antisense Oligonucleotides," Antisense Research and Applications, Chapter 15, 1993, pp. 273-288.

Seth P.P., et al., "Short Antisense Oligonucleotides with Novel 2'-4' Conformationaly Restricted Nucleoside Analogues Show Improved Potency Without Increased Toxicity in Animals, " Journal of Medicinal Chemistry, 2009, vol. 52, No. 1, pp. 10-13.

Shea R G., et al., "Synthesis, Hybridization Properties and Antiviral Activity of Lipid-Oligodeoxynucleotide Conjugates", Nucleic Acids Research, vol. 18, No. 13, 1990, pp. 3777-3783.

Soller K.J., et al., "Reversal of Phospholamban Inhibition of the Sarco(endo)plasmic Reticulum Ca2+-ATPase (SERCA) Using Short, Protein-interacting RNAs and Oligonucleotide Analogs", Journal of Biological Chemistry, Oct. 7, 2016, vol. 291, vol. 41, pp. 21510-21518.

(56) References Cited

OTHER PUBLICATIONS

Soller K.J., et al., "Rheostatic Regulation of the SERCA/ Phospholamban Membrane Protein Complex Using Non-Coding RNA and Single-Stranded DNA oligonucleotides", Scientific Reports, Aug. 21, 2015, vol. 5, Article No. 13000, 14 Pages.
Spaeter D., et al., "Phospholamban Antisense Oligonucleotides Drive the Reversal of Cardiac Dysfunction and Multiple Heart Failure Parameters During Murine Dilated Cardiomyopathy", Abstract P6348 for ESC Congress, Aug. 31-Sep. 4, 2019, European Heart Journal, vol. 40, Supplement 1, pp. 3950.
Svinarchuk F.P., et al., "Inhibition of HIV Proliferation in MT-4 Cells by Antisense Oligonucleotide Conjugated to Lipophilic Groups," Biochimie, 1993, vol. 75, No. 1-2, pp. 49-54.
University of Groningen: "Promising results new treatment option for heart failure", Aug. 30, 2021, Retrieved from https://umcgresearch.org/w/promising-results-new-treatment-option-for-heart-failure, 2 Pages.
Watanabe A., et al., "Phospholamban Ablation by RNA Interference Increases Ca2+ Uptake into Rat Cardiac Myocyte Sarcoplasmic Reticulum", Journal of Molecular and Cellular Cardiology, Jul. 2004, vol. 37, pp. 691-698.
Woolf T.M., et al., "Specificity of Antisense Oligonucleotides in Vivo," Proceedings of the National Academy of Sciences of the United States of America (PNAS), Aug. 1992, vol. 89, No. 16, pp. 7305-7309.
Zhou C., et al., "Fine Tuning of Electrostatics around the Internucleotidic Phosphate through Incorporation of Modified 2',4'-Carbocyclic-LNAs and -ENAs Leads to Significant Modulation of Antisense Properties", J. Org. Chem, 2009, vol. 74, No. 1, pp. 118-134.
Supplementary European Search Report in European Patent Application No. 22753363.5, dated Jun. 3, 2025, 17 Pages.

* cited by examiner

COMPOUNDS AND METHODS FOR REDUCING PLN EXPRESSION

SEQUENCE LISTING

The present application is being filed along with a Sequence Listing in electronic format. The Sequence Listing is provided as a file entitled BIOL0421WOSEQ_ST25.txt, created on Feb. 9, 2022, which is 499 KB in size. The information in the electronic format of the sequence listing is incorporated herein by reference in its entirety.

FIELD

Provided are oligomeric agents, oligomeric compounds, methods, and pharmaceutical compositions for reducing the amount or activity of PLN RNA in a cell or animal, and in certain instances reducing the amount of PLN protein in a cell or animal. Such oligomeric agents, oligomeric compounds, methods, and pharmaceutical compositions are useful to treat cardiomyopathy, heart failure, or arrhythmia.

BACKGROUND

Heart disease is the leading cause of death worldwide. Cardiomyopathy refers to heart muscle diseases that weaken the heart and make it unable to pump effectively. As the heart gets weaker during cardiomyopathy, normal heart muscle can thicken, stiffen, or thin out, impairing its ability to pump blood which can lead to heart failure. Arrhythmia is an irregular or abnormal heartbeat and the leading cause of sudden cardiac deaths. Arrhythmia originating in the lower chambers of the heart, called the ventricles, are particularly dangerous and cause the heart to beat too fast, which impairs blood circulation and can result in cardiac arrest. Ventricular fibrillation (vfib) is a rapid uncoordinated heart rhythm in which the heart's electrical signals often lack a normal and repetitive pattern. Ventricular tachycardia (vtac) is a rapid heart rhythm, which if too fast, can prevent the heart from effectively beating or pumping blood to the entire body and cause loss of consciousness.

SUMMARY

Oligomeric agents, oligomeric compounds, methods, and pharmaceutical compositions of certain embodiments described herein are useful for reducing or inhibiting PLN expression in a cell or animal. In certain embodiments, PLN RNA or protein levels can be reduced in a cell or animal. Also provided are methods of treating cardiomyopathy, heart failure, or arrhythmia.

DETAILED DESCRIPTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well-known and commonly used in the art. Where permitted, all patents, applications, published applications and other publications and other data referred to throughout in the disclosure are incorporated by reference herein in their entirety.

Unless otherwise indicated, the following terms have the following meanings:

As used herein, "2'-deoxynucleoside" means a nucleoside comprising a 2'-H(H) deoxyfuranosyl sugar moiety. In certain embodiments, a 2'-deoxynucleoside is a 2'-β-D-deoxynucleoside and comprises a 2'-β-D-deoxyribosyl sugar moiety, which has the β-D ribosyl configuration as found in naturally occurring deoxyribonucleic acids (DNA). In certain embodiments, a 2'-deoxynucleoside may comprise a modified nucleobase or may comprise an RNA nucleobase (uracil).

As used herein, "2'-MOE" means a 2'-$OCH_2CH_2OCH_3$ group in place of the 2'-OH group of a furanosyl sugar moiety. A "2'-MOE sugar moiety" means a sugar moiety with a 2'-$OCH_2CH_2OCH_3$ group in place of the 2'-OH group of a furanosyl sugar moiety. Unless otherwise indicated, a 2'-MOE sugar moiety is in the β-D-ribosyl configuration. "MOE" means O-methoxyethyl.

As used herein, "2'-MOE nucleoside" means a nucleoside comprising a 2'-MOE sugar moiety.

As used herein, "2'-OMe" means a 2'-$OCH_3$ group in place of the 2'-OH group of a furanosyl sugar moiety. A "2'-O-methyl sugar moiety" or "2'-OMe sugar moiety" means a sugar moiety with a 2'-$OCH_3$ group in place of the 2'-OH group of a furanosyl sugar moiety. Unless otherwise indicated, a 2'-MOE sugar moiety is in the β-D-ribosyl configuration.

As used herein, "2'-OMe nucleoside" means a nucleoside comprising a 2'-OMe sugar moiety.

As used herein, "2'-substituted nucleoside" means a nucleoside comprising a 2'-substituted sugar moiety. As used herein, "2'-substituted" in reference to a sugar moiety means a sugar moiety comprising at least one 2-substituent group other than H or OH.

As used herein, "3' target site" refers to the 3'-most nucleotide of a target nucleic acid which is complementary to an antisense oligonucleotide, when the antisense oligonucleotide is hybridized to the target nucleic acid.

As used herein, "5' target site" refers to the 5'-most nucleotide of a target nucleic acid which is complementary to an antisense oligonucleotide, when the antisense oligonucleotide is hybridized to the target nucleic acid.

As used herein, "5-methylcytosine" means a cytosine modified with a methyl group attached to the 5 position. A 5-methyl cytosine is a modified nucleobase.

As used herein, "abasic sugar moiety" means a sugar moiety of a nucleoside that is not attached to a nucleobase. Such abasic sugar moieties are sometimes referred to in the art as "abasic nucleosides."

As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are oligomeric compounds comprising modified oligonucleotides.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide and the nucleobases of another nucleic acid or one or more regions thereof are capable of hydrogen bonding with one another when the nucleobase sequence of the oligonucleotide and the other nucleic acid are aligned in opposing directions. "Complementary region" in reference to a region of an oligonucleotide means that at least 70% of the nucleobases of that region and the nucleobases of another nucleic acid or one or more regions thereof are capable of hydrogen bonding with one another when the nucleobase sequence of the oligonucleotide and the other nucleic acid are aligned in opposing directions. Complementary nucleobases mean nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Certain modified nucleobases that pair with natural nucleobases or with other modified nucleobases are known in the art and are not considered complementary nucleobases as defined herein unless indicated otherwise. For example, inosine can pair, but is not considered complementary, with adenosine, cytosine, or uracil. Complementary oligonucleotides and/or nucleic acids need not have nucleobase complementarity at each nucleoside. Rather, some mismatches are tolerated. As used herein, "fully complementary" or "100% complementary" in reference to oligonucleotides means that oligonucleotides are complementary to another oligonucleotide or nucleic acid at each nucleoside of the oligonucleotide.

As used herein, "conjugate group" means a group of atoms that is directly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that modifies one or more properties of a molecule compared to the identical molecule lacking the conjugate moiety, including but not limited to pharmacodynamics, pharmacokinetics, stability, binding, absorption, tissue distribution, cellular distribution, cellular uptake, charge and clearance.

As used herein, "constrained ethyl" or "cEt" or "cEt modified sugar moiety" means a β-D ribosyl bicyclic sugar moiety wherein the second ring of the bicyclic sugar is formed via a bridge connecting the 4'-carbon and the 2'-carbon of the β-D ribosyl sugar moiety, wherein the bridge has the formula $4'\text{-}CH(CH_3)\text{—}O\text{-}2'$, and wherein the methyl group of the bridge is in the S configuration.

As used herein, "cEt nucleoside" means a nucleoside comprising a cEt modified sugar moiety.

As used herein, "deoxy region" means a region of 5-12 contiguous nucleotides, wherein at least 70% of the nucleosides comprise a β-D-2'-deoxyribosyl sugar moiety. In certain embodiments, a deoxy region is the gap of a gapmer.

As used herein, "hotspot region" is a range of nucleobases on a target nucleic acid that is amenable to oligomeric agent or oligomeric compound-mediated reduction of the amount or activity of the target nucleic acid.

As used herein, "internucleoside linkage" is the covalent linkage between adjacent nucleosides in an oligonucleotide. As used herein "modified internucleoside linkage" means any internucleoside linkage other than a phosphodiester internucleoside linkage.

As used herein, "linked nucleosides" are nucleosides that are connected in a contiguous sequence (i.e., no additional nucleosides are presented between those that are linked).

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "mismatch" or "non-complementary" means a nucleobase of a first nucleic acid sequence that is not complementary with the corresponding nucleobase of a second nucleic acid sequence or target nucleic acid when the first and second nucleic acid sequences are aligned.

As used herein, "motif" means the pattern of unmodified and/or modified sugar moieties, nucleobases, and/or internucleoside linkages, in an oligonucleotide.

As used herein, "modified nucleoside" means a nucleoside comprising a modified nucleobase and/or a modified sugar moiety.

As used herein, "non-bicyclic modified sugar moiety" means a modified sugar moiety that comprises a modification, such as a substituent, that does not form a bridge between two atoms of the sugar to form a second ring.

As used herein, "nucleobase" means an unmodified nucleobase or a modified nucleobase. A nucleobase is a heterocyclic moiety. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one other nucleobase. A "5-methyl cytosine" is a modified nucleobase. A universal base is a modified nucleobase that can pair with any one of the five unmodified nucleobases.

As used herein, "nucleobase sequence" means the order of contiguous nucleobases in a nucleic acid or oligonucleotide independent of any sugar or internucleoside linkage modification.

As used herein, "nucleoside" means a compound or fragment of a compound comprising a nucleobase and a sugar moiety. The nucleobase and sugar moiety are each, independently, unmodified or modified.

As used herein, "oligomeric agent" means an oligomeric compound and optionally one or more additional features, such as a second oligomeric compound. An oligomeric agent may be a single-stranded oligomeric compound or may be an oligomeric duplex formed by two complementary oligomeric compounds.

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound.

The term "oligomeric duplex" means a duplex formed by two oligomeric compounds having complementary nucleobase sequences.

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to an animal. Certain such carriers enable pharmaceutical compositions to be formulated as, for example, tablets, pills, dragees, capsules, liquids, gels, syrups, slurries, suspension and lozenges for the oral ingestion by a subject.

In certain embodiments, a pharmaceutically acceptable carrier or diluent is sterile water, sterile saline, sterile buffer solution or sterile artificial cerebrospinal fluid.

As used herein "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein "pharmaceutical composition" means a mixture of substances suitable for administering to a subject. For example, a pharmaceutical composition may comprise an oligomeric compound and a sterile aqueous solution.

In certain embodiments, a pharmaceutical composition shows activity in free uptake assay in certain cell lines.

As used herein, "phosphodiester linkage" means a linking group having the following structure:

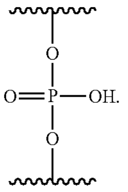

In certain embodiments, a phosphodiester linkage is an internucleoside linkage. In certain embodiments, a phosphodiester linkage links a conjugate moiety to a modified oligonucleotide.

As used herein "prodrug" means a therapeutic agent in a first form outside the body that is converted to a second form within an animal or cells thereof. Typically, conversion of a prodrug within the animal is facilitated by the action of an enzymes (e.g., endogenous or viral enzyme) or chemicals present in cells or tissues and/or by physiologic conditions.

In certain embodiments, the first form of the prodrug is less active than the second form. In certain embodiments, a prodrug comprises a cell-targeting moiety and at least one active compound.

As used herein, "stabilized phosphate group" means a 5'-phosphate analog that is metabolically more stable than a 5'-phosphate as naturally occurs on DNA or RNA.

As used herein, "standard cell assay" means the assays described in the Examples and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the result of a synthetic method that is not designed to control the stereochemical configuration. In certain embodiments, a stereorandom chiral center is a stereorandom phosphorothioate internucleoside linkage.

As used herein, "sugar moiety" means an unmodified sugar moiety or a modified sugar moiety. As used herein, "unmodified sugar moiety" means a 2'-OH(H) ribosyl moiety, as found in RNA (an "unmodified RNA sugar moiety"), or a 2'-H(H) deoxyribosyl sugar moiety, as found in DNA (an "unmodified DNA sugar moiety"). Unmodified sugar moieties have one hydrogen at each of the 1', 3', and 4' positions, an oxygen at the 3' position, and two hydrogens at the 5' position.

As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "target nucleic acid" and "target RNA" mean a nucleic acid that an oligomeric compound is designed to affect. Target RNA means an RNA transcript and includes pre-mRNA and mRNA unless otherwise specified.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound. In certain embodiments, antisense activity is the modulation of splicing of a target pre-mRNA.

As used herein, "antisense agent" means an antisense compound and optionally one or more additional features, such as a sense compound.

As used herein, "antisense compound" means an antisense oligonucleotide and optionally one or more additional features, such as a conjugate group.

As used herein, "sense compound" means a sense oligonucleotide and optionally one or more additional features, such as a conjugate group.

As used herein, "antisense oligonucleotide" means an oligonucleotide, including the oligonucleotide portion of an antisense compound, that is capable of hybridizing to a target nucleic acid and is capable of at least one antisense activity. Antisense oligonucleotides include but are not limited to antisense RNAi oligonucleotides and antisense RNase H oligonucleotides.

As used herein, "sense oligonucleotide" means an oligonucleotide, including the oligonucleotide portion of a sense compound, that is capable of hybridizing to an antisense oligonucleotide.

As used herein, "gapmer" means a modified oligonucleotide comprising an internal region positioned between external regions having one or more nucleosides, wherein the nucleosides comprising the internal region are chemically distinct from the nucleoside or nucleosides comprising the external regions, and wherein the modified oligonucleotide supports RNAse H cleavage. The internal region may be referred to as the "gap" and the external regions may be referred to as the "wings." In certain embodiments, the internal region is a deoxy region. The positions of the internal region or gap refer to the order of the nucleosides of the internal region and are counted starting from the 5'-end of the internal region. Unless otherwise indicated, "gapmer" refers to a sugar motif. In certain embodiments, each nucleoside of the gap is a 2'-β-D-deoxynucleoside. In certain embodiments, the gap comprises one 2'-substituted nucleoside at position 1, 2, 3, 4, or 5 of the gap, and the remainder of the nucleosides of the gap are 2'-β-D-deoxynucleosides. As used herein, the term "MOE gapmer" indicates a gapmer having a gap comprising 2'-β-D-deoxynucleosides and wings comprising 2'-MOE nucleosides. As used herein, the term "mixed wing gapmer" indicates a gapmer having wings comprising modified nucleosides comprising at least two different sugar modifications. Unless otherwise indicated, a gapmer may comprise one or more modified internucleoside linkages and/or modified nucleobases and such modifications do not necessarily follow the gapmer pattern of the sugar modifications.

As used herein, "cell-targeting moiety" means a conjugate group or portion of a conjugate group that is capable of binding to a particular cell type or particular cell types.

As used herein, "hybridization" means the annealing of oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases. In certain embodiments, complementary nucleic acid molecules include, but are not limited to, an antisense compound and a nucleic acid target. In certain embodiments, complementary nucleic acid molecules include, but are not limited to, an oligonucleotide and a nucleic acid target.

As used herein, "RNAi agent" means an antisense agent that acts, at least in part, through RISC or Ago2 to modulate a target nucleic acid and/or protein encoded by a target nucleic acid. RNAi agents include, but are not limited to double-stranded siRNA, single-stranded RNAi (ssRNAi), and microRNA, including microRNA mimics. RNAi agents may comprise conjugate groups and/or terminal groups. In certain embodiments, an RNAi agent modulates the amount and/or activity, of a target nucleic acid. The term RNAi agent excludes antisense agents that act through RNase H.

As used herein, "RNase H agent" means an antisense agent that acts through RNase H to modulate a target nucleic acid and/or protein encoded by a target nucleic acid. In certain embodiments, RNase H agents are single-stranded. In certain embodiments, RNase H agents are double-stranded. RNase H compounds may comprise conjugate groups and/or terminal groups. In certain embodiments, an RNase H agent modulates the amount and/or activity of a target nucleic acid. The term RNase H agent excludes antisense agents that act principally through RISC/Ago2.

As used herein, "treating" means improving a subject's disease or condition by administering an oligomeric agent or oligomeric compound described herein. In certain embodiments, treating a subject improves a symptom relative to the same symptom in the absence of the treatment. In certain embodiments, treatment reduces in the severity or frequency of a symptom, or delays the onset of a symptom, slows the progression of a symptom, or slows the severity or frequency of a symptom.

As used herein, "therapeutically effective amount" means an amount of a pharmaceutical agent or composition that provides a therapeutic benefit to an animal. For example, a therapeutically effective amount improves a symptom of a disease.

Certain Embodiments

1. An oligomeric compound comprising a modified oligonucleotide consisting of 8 to 80 linked nucleosides, wherein the nucleobase sequence of the modified oligonucleotide is at least 80% complementary to an equal length portion of a PLN nucleic acid, and wherein the modified oligonucleotide has at least one modification selected from a modified sugar moiety and a modified internucleoside linkage.

2. The oligomeric compound of embodiment 1, wherein the PLN nucleic acid has the nucleobase sequence of SEQ ID NOs: 1 or 2.

3. The oligomeric compound of embodiment 1 or 2, wherein the nucleobase sequence of the modified oligonucleotide is at least 80% complementary to an equal length portion within nucleobases 3278-3293, 3281-3296, 3282-3297, 3284-3299, 3286-3301, 3287-3302, 3288-3303, 3327-3342, 3329-3344, 3332-3347, 3333-3348, 3336-3351, 3337-3352, 3338-3353, 3339-3354, 3340-3355, 3341-3356, 3343-3358, 3345-3360, 3348-3363, 3349-3364, 3350-3365, 3351-3366, 3352-3367, 3353-3368, 3354-3369, 3355-3370, 3356-3371, 3357-3372, 3358-3373, 3395-3410, 3396-3411, 3405-3420, 3406-3421, 3408-3423, 3409-3424, 3410-3425, 3412-3427, 3496-3511, 3497-3512, 3498-3513, 3499-3514, 3598-3613, 3612-3627, 3614-3629, 3615-3630, 3616-3631, 3617-3632, 3618-3633, 3619-3634, 3620-3635, 3622-3637, 3703-3718, 3704-3719, 3715-3730, 3716-3731, 3723-3738, 3724-3739, 3799-3814, 3801-3816, 3802-3817, 3803-3818, 3804-3819, 3805-3820, 3806-3821, 3807-3822, 3808-3823, 3809-3824, 3811-3826, 3814-3829, 3815-3830, 3816-3831, 3817-3832, 3821-3836, 3823-3838, 3830-3845, 3831-3846, 3848-3863, 3849-3864, 3850-3865, 3851-3866, 3861-3876, 3863-3878, 3864-3879, 3869-3884, 3871-3886, 3976-3991, 3977-3992, 3978-3993, 3980-3995, 3981-3996, 4116-4131, 4159-4174, 4204-4219, 4207-4222, 4208-4223, 4209-4224, 4210-4225, 4211-4226, 4212-4227, 4214-4229, 4221-4236, 4231-

4246, 4232-4247, 4233-4248, 4234-4249, 4235-4250, 4236-4251, 4238-4253, 4252-4267, 4253-4268, 4266-4281, 4348-4363, 4349-4364, 4350-4365, 4367-4382, 4373-4388, 4374-4389, 4375-4390, 4510-4525, 4511-4526, 4513-4528, 4515-4530, 4516-4531, 4517-4532, 4518-4533, 4519-4534, 4530-4545, 4537-4552, 4539-4554, 4540-4555, 4541-4556, 4542-4557, 4543-4558, 4544-4559, 4545-4560, 4562-4577, 4614-4629, 4617-4632, 4619-4634, 4620-4635, 4621-4636, 4622-4637, 4623-4638, 4624-4639, 4638-4653, 4640-4655, 4641-4656, 4642-4657, 4643-4658, 4665-4680, 4672-4687, 4693-4708, 4694-4709, 4695-4710, 4696-4711, 4697-4712, 4750-4765, 4751-4766, 4752-4767, 4753-4768, 4774-4789, 4802-4817, 4804-4819, 4805-4820, 4806-4821, 4807-4822, 4823-4838, 4825-4840, 4826-4841, 4828-4843, 4860-4875, 4862-4877, 4869-4884, 4872-4887, 4874-4889, 4878-4893, 4881-4896, 4883-4898, 4884-4899, 4942-4957, 4943-4958, 4945-4960, 4946-4961, 4957-4972, 4958-4973, 4960-4975, 4961-4976, 4964-4979, 4965-4980, 4966-4981, 4968-4983, 4969-4984, 4971-4986, 4972-4987, 4974-4989, 4984-4999, 4985-5000, 4987-5002, 4988-5003, 5024-5039, 5127-5142, 5133-5148, 5134-5149, 5158-5173, 5159-5174, 5160-5175, 5163-5178, 5294-5309, 5341-5356, 5359-5374, 5394-5409, 5399-5414, 5400-5415, 5401-5416, 5402-5417, 5404-5419, 5411-5426, 5413-5428, 5414-5429, 5415-5430, 5416-5431, 5417-5432, 5418-5433, 5419-5434, 5421-5436, 5427-5442, 5428-5443, 5489-5504, 5494-5509, 5495-5510, 5497-5512, 5498-5513, 5498-5515, 5498-5517, 5499-5514, 5499-5515, 5499-5516, 5499-5518, 5500-5515, 5500-5516, 5500-5517, 5501-5516, 5501-5514, 5501-5517, 5502-5517, 5502-5515, 5503-5518, 5504-5519, 5505-5520, 5506-5521, 5511-5526, 5532-5547, 5533-5548, 5534-5549, 5547-5562, 5557-5572, 5558-5573, 5559-5574, 5560-5575, 5562-5577, 5563-5578, 5565-5580, 5599-5614, 5673-5688, 5674-5689, 5675-5690, 5676-5691, 5677-5692, 5678-5693, 5679-5694, 5694-5709, 5695-5710, 5696-5711, 5697-5712, 5698-5713, 5774-5789, 5827-5842, 5845-5860, 5847-5862, 5848-5863, 5850-5865, 5851-5866, 5855-5870, 5859-5874, 5924-5939, 5925-5940, 5926-5941, 5927-5942, 5929-5944, 5930-5945, 5931-5946, 5932-5947, 6008-6023, 6009-6024, 6039-6054, 6053-6068, 6054-6069, 6055-6070, 6059-6074, 6066-6081, 6069-6084, 6070-6085, 6076-6091, 6092-6107, 6098-6113, 6112-6127, 6114-6129, 6117-6132, 6118-6133, 6119-6134, 6124-6139, 6125-6140, 6126-6141, 6147-6162, 6154-6169, 6155-6170, 6156-6171, 6157-6172, 6176-6191, 6177-6192, 6185-6200, 6186-6201, 6187-6202, 6188-6203, 6202-6217, 6209-6224, 6243-6258, 6249-6264, 6267-6282, 6268-6283, 6274-6289, 6275-6290, 6291-6306, 6338-6353, 6352-6367, 6353-6368, 6354-6369, 6365-6380, 6366-6381, 6368-6383, 6369-6384, 6403-6418, 6405-6420, 6406-6421, 6407-6422, 6408-6423, 6409-6424, 6410-6425, 6411-6426, 6413-6428, 6468-6483, 6471-6486, 6502-6517, 6546-6561, 6554-6569, 6555-6570, 6556-6571, 6557-6572, 6569-6584, 6574-6589, 6575-6590, 6576-6591, 6577-6592, 6578-6593, 6579-6594, 6644-6659, 6646-6661, 6647-6662, 6664-6679, 6665-6680, 6666-6681, 6667-6682, 6676-6691, 6677-6692, 6746-6761, 6804-6819, 6806-6821, 6825-6840, 6826-6841, 6827-6842, 6828-6843, 6831-6846, 6833-6848, 6834-6849, 6875-6890, 6877-6892, 6879-6894, 6880-6895, 6881-6896, 6893-6908, 6896-6911, 6898-6913, 6899-6914, 6900-6915, 6901-6916, 6903-6918, 6904-6919, 6906-6921, 6907-6922, 6908-6923, 6920-6935, 6921-6936, 6922-6937, 6923-6938, 6927-6942, 6928-6943, 6930-6945, 6937-6952, 6939-6954, 6940-6955, 6941-6956, 6942-6957, 6943-6958, 6944-6959, 6945-6960, 6947-6962, 6965-6980, 6966-6981, 6967-6982, 6968-6983, 6972-6987, 6975-6990, 7029-7044, 7042-7057, 7047-7062, 7050-7065, 7073-7088, 7082-7097, 7083-7098, 7102-7117, 7106-7121, 7107-7122, 7108-7123, 7120-7135, 7122-7137, 7123-7138, 7124-7139, 7125-7140, 7126-7141, 7128-7143, 7129-7144, 7130-7145, 7131-7146, 7279-7294, 7280-7295, 7282-7297, 7283-7298, 7284-7299, 7285-7300, 7286-7301, 7287-7302, 7320-7335, 7341-7356, 7342-7357, 7344-7359, 7353-7368, 7354-7369, 7356-7371, 7357-7372, 7358-7373, 7359-7374, 7360-7375, 7361-7376, 7362-7377, 7377-7392, 7378-7393, 7392-7407, 7393-7408, 7411-7426, 7425-7440, 7436-7451, 7457-7472, 7458-7473, 7459-7474, 7460-7475, 7461-7476, 7463-7478, 7464-7479, 7470-7485, 7516-7531, 7518-7533, 7519-7534, 7520-7535, 7521-7536, 7522-7537, 7546-7561, 7548-7563, 7553-7568, 7554-7569, 7555-7570, 7556-7571, 7558-7573, 7560-7575, 7561-7576, 7562-7577, 7563-7578, 7564-7579, 7565-7580, 7566-7581, 7568-7583, 7587-7602, 7588-7603, 7589-7604, 7595-7610, 7638-7653, 7679-7694, 7726-7741, 7779-7794, 7797-7812, 7799-7814, 7806-7821, 7857-7872, 7859-7874, 7860-7875, 7861-7876, 7862-7877, 7863-7878, 7864-7879, 7865-7880, 7867-7882, 7876-7891, 7878-7893, 7888-7903, 7889-7904, 7893-7908, 7908-7923, 7929-7944, 7965-7980, 7967-7982, 7968-7983, 8047-8062, 8058-8073, 8061-8076, 8089-8104, 8090-8105, 8163-8178, 8182-8197, 8194-8209, 8195-8210, 8196-8211, 8197-8212, 8284-8299, 8285-8300, 8286-8301, 8287-8302, 8288-8303, 8326-8341, 8336-8351, 8352-8367, 8353-8368, 8368-8383, 8393-8408, 8412-8427, 8413-8428, 8415-8430, 8418-8433, 8427-8442, 8447-8462, 8493-8508, 8494-8509, 8495-8510, 8496-8511, 8498-8513, 8542-8557, 8573-8588, 8621-8636, 8627-8642, 8628-8643, 8638-8653, 8639-8654, 8641-8656, 8653-8668, 8655-8670, 8703-8718, 8708-8723, 8732-8747, 8733-8748, 8739-8754, 8774-8789, 8776-8791, 8777-8792, 8818-8833, 8823-8838, 8824-8839, 8826-8841, 8827-8842, 8850-8865, 8855-8870, 8942-8957, 8943-8958, 8944-8959, 8955-8970, 8961-8976, 8962-8977, 8963-8978, 8964-8979, 9377-9392, 9443-9458, 9474-9489, 9523-9538, 9524-9539, 9525-9540, 9526-9541, 9528-9543, 9536-9551, 9537-9552, 9538-9553, 9540-9555, 9541-9556, 9545-9560, 9549-9564, 9550-9565, 9587-9602, 9630-9645, 9641-9656, 9642-9657, 9646-9661, 9647-9662, 9648-9663, 9649-9664, 9651-9666, 9660-9675, 9668-9683, 9669-9684, 9672-9687, 9697-9712, 9702-9717, 9703-9718, 9706-9721, 9707-9722, 9708-9723, 9709-9724, 9710-9725, 9711-9726, 9720-9735, 9727-9742, 9752-9767, 9756-9771, 9788-9803, 9934-9949, 9936-9951, 9937-9952, 9938-9953, 9939-9954, 9940-9955, 10019-10034, 10054-10069, 10062-10077, 10081-10096, 10106-10121, 10117-10132, 10443-10458, 10444-10459, 10445-10460, 10480-10495, 10481-10496, 10486-10501, 10489-10504, 10490-10505, 10491-10506, 10532-10547, 10623-10638, 10638-10653, 10645-10660, 10718-10733, 10719-10734, 10720-10735, 10721-10736, 10722-10737, 10723-10738, 10724-10739, 10747-10762, 10770-10785, 11066-11081, 11068-11083, 11104-11119, 11111-11126, 11112-11127, 11115-11130, 11116-11131, 11118-11133, 11130-11145, 11144-11159, 11224-11239, 11225-11240, 11237-11252, 11258-11273, 11259-11274, 11302-11317, 11353-11368, 11356-11371, 11368-11383, 11369-11384, 11409-11424, 11410-11425, 11411-11426, 11412-11427, 11413-11428, 11414-11429, 11415-11430, 11417-11432, 11457-11472, 11458-11473, 11467-11482, 11474-11489, 11475-11490, 11509-11524, 11510-11525, 11511-11526, 11524-11539, 11525-11540, 11526-11541, 11527-11542, 11529-11544, 11530-11545, 11622-11637, 11631-11646, 11632-11647, 11633-11648, 11634-11649, 11635-11650, 11636-11651, 11639-11654, 11670-11685, 11678-11693, 11679-11694, 11680-11695, 11681-11696, 11682-11697, 11684-11699, 11685-11700, 11726-11741, 11727-11742, 11740-11755, 11741-11756, 11742-11757, 11743-11758, 11799-11814, 11832-11847, 11833-11848, 11854-11869, 11855-11870, 11856-11871, 11857-11872, 11858-11873, 11859-11874, 11900-11915, 11931-11946, 11956-11971, 11988-12003, 11989-12004, 11990-12005, 11991-12006, 11992-12007, 11993-12008, 11994-12009, 11995-12010, 11997-12012, 11998-12013, 11999-12014, 12000-12015, 12015-12030, 12016-12031, 12017-12032, 12027-12042, 12032-12047, 12040-12055, 12041-12056, 12042-12057, 12076-12091, 12080-12095, 12081-12096, 12082-12097, 12084-12099, 12085-12100, 12086-12101, 12087-12102, 12088-12103, 12089-12104, 12090-12105, 12092-12107, 12194-12209, 12195-12210, 12238-12253, 12239-12254, 12241-12256, 12242-12257, 12243-12258, 12246-12261, 12282-12297, 12283-12298, 12285-12300, 12286-12301, 12287-12302, 12288-12303, 12307-12322, 12308-12323, 12310-12325, 12312-12327, 12315-12330, 12348-12363, 12355-12370, 12356-12371, 12357-12372, 12368-12383, 12388-12403, 12389-12404, 12390-12405, 12391-12406, 12392-12407, 12470-12485, 12471-12486, 12472-12487, 12473-12488, 12474-12489, 12498-12513, 12529-12544, 12530-12545, 12546-12561, 12548-12563, 12550-12565, 12551-12566, 12585-12600, 12721-12736, 12722-12737, 12723-12738, 12724-12739, 12727-12742, 12732-12747, 12733-12748, 12734-12749, 12735-12750, 12760-12775, 12812-12827, 12813-12828, 12817-12832, 12818-12833, 12912-12927, 12915-12930, 12929-12944, 12943-12958, 12946-12961, 13243-13258, 13327-13342, 13409-13424, 13431-13446, 13438-13453, 13460-13475, 13461-13476, 13484-13499, 13485-13500, 13486-13501, 13489-13504, 13490-13505, 13491-13506, 13492-13507, 13493-13508, 13525-13540, 13528-13543, 13529-13544, 13530-13545, 13717-13732, 13736-13751, 13770-13785, 13776-13791, 13777-13792, 13786-13801, 13814-13829, 13816-13831, 13818-13833, 13819-13834, 13820-13835, 13821-13836, 13822-13837, 13823-13838, 13835-13850, 13836-13851, 13837-13852, 13838-13853, 13839-13854, 13843-13858, 13870-13885, 13872-13887, 13875-13890, 13876-13891, 13877-13892, 13878-13893, 13879-13894, 13880-13895, 13881-13896, 13882-13897, 13883-13898, 13885-13900, 13904-13919, 13905-13920, 13906-13921, 13907-13922, 13908-13923, 13910-13925, 13912-13927, 13918-13933, 13924-13939, 13926-13941, 13927-13942, 13930-13945, 13934-13949, 13935-13950, 13936-13951, 13937-13952, 13938-13953, 13939-13954, 13940-13955, 13941-13956, 13942-13957, 13943-13958, 13944-13959, 13945-13960, 13946-13961, 13952-13967, 13953-13968, 13954-13969, 13955-13970, 13956-13971, 13957-13972, 13958-13973, 13959-13974, 13960-13975, 13961-13976, 13962-13977, 13963-13978, 13964-13979, 13965-13980, 13966-13981, 13967-13982, 13968-13983, 13969-13984, 13970-13985, 13973-13988, 13976-13991, 14000-14015, 14003-14018, 14028-14043, 14030-14045, 14032-14047, 14035-14050, 14036-14051, 14038-14053, 14039-14054, 14040-14055, 14041-14056, 14045-14060, 14047-14062, 14048-14063, 14049-14064, 14050-14065, 14051-14066, 14053-14068, 14054-14069, 14055-14070, 14056-14071, 14059-14074, 14060-14075, 14061-14076, 14062-14077, 14063-14078, 14064-14079, 14065-14080, 14066-14081, 14078-14093, 14081-14096, 14082-14097, 14084-14099, 14085-14100, 14086-14101, 14087-14102, 14088-14103, 14089-14104, 14090-14105, 14091-14106, 14092-14107, 14093-14108, 14095-14110, 14096-14111, 14097-14112, 14098-14113, 14099-14114, 14100-14115, 14102-14117, 14105-14120, 14110-14125, 14111-14126, 14112-14127, 14113-14128, 14115-14130, 14117-14132, 14119-14134, 14130-14145, 14163-14178, 14165-14180, 14166-14181, 14167-14182, 14169-14184, 14170-14185, 14174-14189, 14180-14195, 14181-14196, 14203-14218, 14207-14222, 14209-14224, 14212-14227, 14217-14232, 14220-14235, 14222-14237, 14223-14238, 14224-14239, 14225-14240, 14232-14247, 14233-14248, 14235-14250, 14242-14257, 14244-14259, 14247-14262, 14248-14263, 14249-14264, 14250-14265, 14251-14266, 14252-14267, 14253-14268, 14254-14269, 14255-14270, 14256-14271, 14257-14272, 14316-14331, 14317-14332, 14318-14333, 14319-14334, 14321-14336, 14324-14339, 14327-14342, 14337-14352, 14338-14353, 14339-14354, 14340-14355, 14341-14356, 14342-14357, 14343-14358, 14344-14359, 14345-14360, 14346-14361, 14347-14362, 14398-14413, 14400-14415, 14401-14416, 14403-14418, 14404-14419, 14405-14420, 14406-14421, 14408-14423, 14409-14424, 14410-14425, 14412-14427, 14443-14458, 14479-14494, 14480-14495, 14482-14497, 14504-14519, 14507-14522, 14508-14523, 14509-14524, 14510-14525, 14511-14526, 14512-14527, 14513-14528, 14514-14529, 14515-14530, 14515-14532, 14515-14534, 14516-14531, 14516-14532, 14516-14533, 14517-14532, 14517-14533, 14518-14531, 14519-14534, 14520-14535, 14522-14537, 14534-14549, 14535-14550, 14553-14568, 14569-14584, 14570-14585, 14571-14586, 14573-14588, 14601-14616, 14602-14617, 14603-14618, 14605-14620, 14606-14621, 14607-14622, 14608-14623, 14609-14624, 14610-14625, 14611-14626, 14612-14627, 14613-14628, 14614-14629, 14615-14630, 14616-14631, 14655-14670, 14656-14671, 14658-14673, 14659-14674, 14681-14696, 14683-14698, 14684-14699, 14684-14701, 14684-14703, 14685-14700, 14685-14701, 14685-14702, 14686-14701, 14686-14702, 14687-14702, 14687-14700, 14688-14703, 14689-14704, 14691-14706, 14692-14707, 14696-14711, 14703-14718, 14704-14719, 14705-14720, 14706-14721, 14707-14722, 14708-14723, 14709-14724, 14710-14725, 14711-14726, 14712-14727, 14713-14728, 14714-14729, 14759-14774, 14760-14775, 14761-14776, 14762-14777, 14763-14778, 14764-14779, 14765-14780, 14766-14781, 14767-14782, 14768-14783, 14769-14784, 14770-14785, 14771-14786, 14772-14787, 14773-14788, 14774-14789, 14775-14790, 14776-14791, 14779-14794, 14787-14802, 14792-14807, 14793-14808, 14794-14809, 14797-14812, 14798-14813, 14800-14815, 14818-14833, 14822-14837, 14823-14838, 14824-14839, 14825-14840, 14826-14841, 14827-14842, 14828-14843, 14829-14844, 14830-14845, 14831-14846, 14832-14847, 14833-14848, 14834-14849, 14835-14850, 14841-14856, 14842-14857, 14843-14858, 14844-14859, 14845-14860, 14846-14861, 14847-14862, 14848-14863, 14849-14864, 14850-14865, 14851-14866, 14852-14867, 14853-14868, 14855-14870, 14856-14871, 14857-14872, 14858-14873, 14859-14874, 14861-14876, 14862-14877, 14863-14878, 14864-14879, 14866-14881, 14877-14892, 14878-14893, 14880-14895, 14881-14896, 14889-14904, 14898-14913, 14899-14914, 14901-14916, 14903-14918, 14904-14919, 14905-14920, 14906-14921, 14913-14928, 14915-14930, 14916-14931, 14917-14932, 14918-14933, 14919-14934, 14921-14936, 14922-14937, 14923-14938, 14924-14939, 14925-14940, 14926-14941, 14927-14942, 14928-14943, 14929-14944, 14930-14945, 14931-14946, 14932-14947, 14933-14948, 14934-14949, 14935-14950, 14936-14951, 14937-14952, 14938-14953, 14938-14955, 14938-14957, 14939-14954, 14939-14955, 14939-14956, 14939-14958, 14940-14955, 14940-14956, 14940-14957, 14940-14959, 14941-14956, 14941-14954, 14941-14957, 14941-14958, 14941-14960, 14942-14957, 14942-14955, 14942-14958, 14942-14959, 14942-14961, 14943-14958, 14943-14956, 14943-14959, 14943-14960, 14943-14962, 14944-14959, 14944-14957, 14944-14960, 14944-14961, 14945-14960, 14945-14958, 14945-14961, 14946-14961, 14946-14959, 14948-14963, 14956-14971, 14957-14972, 14958-14973, 14959-14974, 14960-14975, 14961-14976, 14962-14977, 14963-14978, 14964-14979, 14965-14980, 14966-14981, 14968-14983, 14969-14984, 14970-14985, 14987-15002, 14992-15007, 14993-15008, 14994-15009, 14995-15010, 14996-15011, 15003-15018, 15005-15020, 15006-15021, 15007-15022, 15008-15023, 15009-15024, 15010-15025, 15011-15026, 15012-15027, 15013-15028, 15014-15029, 15015-15030, 15016-15031, 15017-15032, 15019-15034, 15142-15157, 15143-15158, 15150-15165, 15151-15166, 15152-15167, 15153-15168, 15154-15169, 15155-15170, 15156-15171, 15157-15172, 15158-15173, 15159-15174, 15160-15175, 15161-15176, 15162-15177, 15163-15178, 15164-15179, 15182-15197, 15184-15199, 15185-15200, 15186-15201, 15195-15210, 15197-15212, 15198-15213, 15199-15214, 15200-15215, 15201-15216, 15202-15217, 15203-15218, 15204-15219, 15205-15220, 15206-15221, 15207-15222, 15208-15223, 15209-15224, 15210-15225, 15211-15226, 15214-15229, 15215-15230, 15216-15231, 15217-15232, 15218-15233, 15219-15234, 15220-15235, 15221-15236, 15222-15237, 15222-15239, 15222-15241, 15223-15238, 15223-15239, 15223-15240, 15224-15239, 15224-15240, 15225-15240, 15225-15238, 15227-15242, 15228-15243, 15229-15244, 15230-15245, 15231-15246, 15232-15247, 15233-15248, 15234-15249, 15235-15250, 15236-15251, 15237-15252, 15238-15253, 15239-15254, 15247-15262, 15248-15263, 15249-15264, 15250-15265, 15251-15266, 15252-15267, 15253-15268, 15254-15269, 15255-15270, 15256-15271, 15257-15272, 15258-15273, 15259-15274, 15260-15275, 15261-15276, 15293-15308, 15299-15314, 15301-15316, 15302-15317, 15303-15318, 15304-15319, 15305-15320, 15320-15335, 15321-15336, 15323-15338, 15411-15426, 15414-15429, 15415-15430, 15416-15431, 15417-15432, 15496-15511, 15501-15516, 15504-15519, 15505-15520, 15506-15521, 15507-15522, 15508-15523, 15509-15524, 15510-15525, 15511-15526, 15512-15527, 15513-15528, 15515-15530, 15556-15571, 15558-15573, 15559-15574, 15560-15575, 15562-15577, 15569-15584, 15571-15586, 15574-15589, 15593-15608, 15594-15609, 15595-15610, 15596-15611, 15598-15613, 15599-15614, 15600-15615, 15601-15616, 15602-15617, 15603-15618, 15604-15619, 15605-15620, 15627-15642, 15629-15644, 15630-15645, 15631-15646, 15632-15647, 15633-15648, 15635-15650, 15636-15651, 15639-15654, 15640-15655, 15641-15656, 15642-15657, 15658-15673, 15659-15674, 15660-15675, 15661-15676, 15665-15680, 15666-15681, 15667-15682, 15668-15683, 15671-15686, 15673-15688, 15674-15689, 15675-15690, 15681-15696, 15682-15697, 15683-15698, 15684-15699, 15685-15700, 15686-15701, 15687-15702, 15740-15755, 15741-15756, 15753-15768, 15757-15772, 15758-15773, 15761-15776, 15762-15777, 15763-15778, 15765-15780, 15788-15803, 15812-15827, 15813-15828, 15814-15829, 15815-15830, 15816-15831, 15826-15841, 15827-15842, 15833-15848, 15858-15873, 15861-15876, 15863-15878, 15864-15879, 15865-15880, 15866-15881, 15867-15882, 15868-15883, 15869-15884, 15870-15885, 15871-15886, 15872-15887, 15873-15888, 15874-15889, 15875-15890, 15876-15891, 15877-15892, 15878-15893, 15882-15897, 15883-15898, 15910-15925, 15911-15926, 15912-15927, 15913-15928, 15914-15929, 15943-15958, 15947-15962, 15949-15964, 15950-15965, 15951-15966, 15955-15970, 15973-15988, 15974-15989, 15979-15994, 15980-15995, 16000-16015, 16008-16023, 16010-16025, 16026-16041, 16027-16042, 16030-16045, 16032-16047, 16034-16049, 16036-16051, 16037-16052, 16038-16053, 16039-16054, 16056-16071, 16057-16072, 16080-16095, 16117-16132, 16118-16133, 16216-16231, 16248-16263, 16265-16280, 16266-16281, 16268-16283, 16269-16284, 16273-16288, 16300-16315, 16305-16320, 16306-16321, 16327-16342, 16329-16344, 16422-16437, 16427-16442, 16428-16443, 16550-16565, 16557-16572, 16564-16579, 16569-16584, 16582-16597, 16592-16607, 16617-16632, or 16676-16691 of SEQ ID NO: 2.

4. The oligomeric compound of any of embodiments 1-3, wherein the nucleobase sequence of the modified oligonucleotide is at least 80% complementary to an equal length portion within nucleobases 3341-3368, 4516-4533, 5498-5517, 14337-14357, 14569-14588, 14607-14631, 14683-14703, 14828-14848, 14939-14958, 15222-15243, or 15251-15273 of SEQ ID NO: 2.

5. The oligomeric compound of any of embodiments 1-4, wherein the nucleobase sequence of the modified oligonucleotide is at least 80% complementary to an equal length portion within nucleobases 5499-5514, 5500-5515, 5501-5516, 14686-14701, 14941-14956, 14942-14957, or 15224-15239 of SEQ ID NO: 2.

6. The oligomeric compound of any of embodiments 1-5, wherein the nucleobase sequence of the modified oligonucleotide is at least 85%, at least 90%, at least 95%, or 100% complementary to an equal length portion of the PLN nucleic acid.

7. An oligomeric compound, wherein the oligomeric compound comprises a modified oligonucleotide consisting of 8 to 80 linked nucleosides, wherein the nucleobase sequence of the modified oligonucleotide comprises at least 8, at least 9, at least 10, at least 11, at least 12, at least 13, at least 14, at least 15, at least 16, at least 17, at least 18, at least 19, or at least 20 contiguous nucleobases of any of the nucleobase sequences of any of SEQ ID NOs: 15-1712.

8. The oligomeric compound of embodiment 7, wherein the nucleobase sequence of the modified oligonucleotide comprises the nucleobase sequence of any of SEQ ID NOs: 15-1712.

9. The oligomeric compound of embodiment 8, wherein the modified oligonucleotide has a nucleobase sequence consisting of the nucleobase sequence of any of SEQ ID NOs: 15-1712.

10. The oligomeric compound of any of embodiments 7-9, wherein the modified oligonucleotide has a nucleobase sequence comprising at least 8, at least 9, at least 10, at least 11, at least 12, at least 13, at least 14, at least 15, or at least 16 contiguous nucleobases of any of the nucleobase sequences of SEQ ID NOs: 45, 120, 185, 609, 675, 737, or 752.

11. The oligomeric compound of embodiment 10, wherein the modified oligonucleotide consists of 16 to 80 linked nucleoside, wherein the nucleobase sequence of the modified oligonucleotide comprises the nucleobase sequence of any of SEQ ID NOs: 45, 120, 185, 609, 675, 737, or 752.

12. The oligomeric compound of embodiment 11, wherein the modified oligonucleotide consists of 16 linked nucleosides and has a nucleobase sequence consisting of the nucleobase sequence of any one of SEQ ID NOs: 45, 120, 185, 609, 675, 737, or 752.

13. The oligomeric compound of any of embodiments 7-11, wherein the nucleobase sequence of the modified oligonucleotide is at least 85%, at least 90%, at least 95%, or 100% complementary to an equal length portion of a PLN nucleic acid, wherein the PLN nucleic acid has the nucleobase sequence of SEQ ID NOs: 1 or 2.

14. The oligomeric compound of any of embodiments 1-13, wherein the modified oligonucleotide consists of 10 to 25, 10 to 30, 10 to 50, 12 to 20, 12 to 25, 12 to 30, 12 to 50, 13 to 20, 13 to 25, 13 to 30, 13 to 50, 14 to 20, 14 to 25, 14 to 30, 14 to 50, 15 to 20, 15 to 25, 15 to 30, 15 to 50, 16 to 18, 16 to 20, 16 to 25, 16 to 30, 16 to 50, 17 to 20, 17 to 25, 17 to 30, 17 to 50, 18 to 20, 18 to 25, 18 to 30, 18 to 50, 19 to 20, 19 to 25, 19 to 30, 19 to 50, 20 to 25, 20 to 30, 20 to 50, 21 to 25, 21 to 30, 21 to 50, 22 to 25, 22 to 30, 22 to 50, 23 to 25, 23 to 30, or 23 to 50 linked nucleosides.

15. The oligomeric compound of any of embodiments 1-14, wherein at least one nucleoside of the modified oligonucleotide comprises a modified sugar moiety.

16. The oligomeric compound of embodiment 15, wherein the modified sugar moiety comprises a bicyclic sugar moiety.

17. The oligomeric compound of embodiment 16, wherein the bicyclic sugar moiety comprises a 2'-4' bridge selected from $—O—CH_2—$; and $—O—CH(CH_3)—$.

18. The oligomeric compound of embodiment 15, wherein the modified sugar moiety comprises a non-bicyclic modified sugar moiety.

19. The oligomeric compound of embodiment 18, wherein the non-bicyclic modified sugar moiety is a 2'-MOE sugar moiety or 2'-OMe sugar moiety.

20. The oligomeric compound of any of embodiments 1-19, wherein at least one nucleoside of the modified oligonucleotide compound comprises a sugar surrogate.

21. The oligomeric compound of any of embodiments 1-20, wherein the modified oligonucleotide comprises at least one modified internucleoside linkage.

22. The oligomeric compound of embodiment 21, wherein at least one modified internucleoside linkage is a phosphorothioate internucleoside linkage.

23. The oligomeric compound of embodiment 22, wherein each internucleoside linkage is a modified internucleoside linkage.

24. The oligomeric compound of embodiment 23, wherein the modified internucleoside linkage is a phosphorothioate internucleoside linkage.

25. The oligomeric compound of any of embodiments 1-20, wherein each internucleoside linkage of the modified oligonucleotide is independently selected from a phosphodiester internucleoside linkage and a phosphorothioate internucleoside linkage.

26. The oligomeric compound of any of embodiments 1-25, wherein the modified oligonucleotide comprises at least one modified nucleobase.

27. The oligomeric compound of embodiment 26, wherein the modified nucleobase is 5-methylcytosine.

28. The oligomeric compound of embodiment 27, wherein each cytosine is a 5-methylcytosine.

29. The oligomeric compound of any of embodiments 1-28, wherein the modified oligonucleotide comprises a deoxy region consisting of 5-12 contiguous 2'-deoxynucleosides.

30. The oligomeric compound of embodiment 29, wherein each nucleoside of the deoxy region is a 2'-β-D-deoxynucleoside.

31. The oligomeric compound of embodiment 29 or 30, wherein the deoxy region consists of 6, 7, 8, 9, 10, or 6-10 linked nucleosides.

32. The oligomeric compound of any of embodiments 29-31, wherein each nucleoside immediately adjacent to the deoxy region comprises a modified sugar moiety.

33. The oligomeric compound of any of embodiments 29-32, wherein the deoxy region is flanked on the 5'-side by a 5'-region consisting of 1-6 linked 5'-region nucleosides and on the 3'-side by a 3'-region consisting of 1-6 linked 3'-region nucleosides; wherein the 3'-most nucleoside of the 5' external region comprises a modified sugar moiety; and the 5'-most nucleoside of the 3' external region comprises a modified sugar moiety.

34. The oligomeric compound of embodiment 33, wherein each nucleoside of the 3' external region comprises a modified sugar moiety.

35. The oligomeric compound of embodiment 33 or 34, wherein each nucleoside of the 5' external region comprises a modified sugar moiety.

36. The oligomeric compound of embodiment 35, wherein the modified oligonucleotide has:

a 5' external region consisting of 1-6 linked nucleosides;

a deoxy region consisting of 6-10 linked nucleosides; and a 3' external region consisting of 1-6 linked nucleosides;

wherein each of the 5' external region nucleosides and each of the 3' external region nucleosides is a cEt nucleoside or a 2'-MOE nucleoside; and each of the deoxy region nucleosides is a 2'-β-D-deoxynucleoside.

37. The oligomeric compound of any of embodiments 35, wherein the modified oligonucleotide has a sugar motif comprising:

a 5' external region consisting of 3-6 linked nucleosides;

a deoxy region consisting of 7-8 linked nucleosides; and a 3' external region consisting of 3-6 linked nucleosides; wherein each of the 3' external region nucleosides is selected from a 2'-MOE nucleoside and a cEt nucleoside, and the 5' external region has the following formula:

(Nk)n(Nd)(Nx)

wherein each Nk is a bicylic nucleoside, Nx 2'-OMe nucleoside and Nd is a 2'-β-D-deoxynucleoside; and n is from 1-4.

38. An oligomeric compound of any of embodiments 1-28, wherein the modified oligonucleotide has a sugar motif (5' to 3') selected from: kkkddddddddddkkk, kkdddddddddkekek, kkkdddddddddkkke, kkkdydd-ddddddkkk, kkddddddddddkk, kkkddddddddddkeee, kkkddddddddddkkee, kkkddddddddddkkkk, kkkkddddddddddkkk, kkkddddddddddkeeee, kkkddddddddddkkeee, kkkkddddddddddkkkk, kkkkkddddddddddkkkkk, ekdddddddddkekek, ekkddddddddddkkk, ekkdddddddddkkke, keddddddddd-kekek, kekddddddddddkkk, kekdddddddddkkke, kkeddddddddddkkk, and kkedddddddddkkke, wherein each "d" represents a 2'-β-D-deoxyribosyl sugar moiety, each "y" represents a 2'-OMe sugar moiety, each "e" represents a 2'-MOE sugar moiety, and each "k" represents a cEt modified sugar moiety.

39. An oligomeric compound comprising a modified oligonucleotide according to the following chemical notation: ${}^{m}C_{ks}{}^{m}C_{ks}A_{ks}T_{ds}A_{ds}{}^{m}C_{ds}T_{ds}T_{ds}G_{ds}A_{ds}T_{ds}T_{ds}{}^{m}C_{ds}T_{ks}{}^{m}C_{ks}A_{k}$ (SEQ ID NO: 185), wherein:

A=an adenine nucleobase, ${}^{m}C$=a 5-methyl cytosine nucleobase,

G=a guanine nucleobase,

T=a thymine nucleobase, k=a cEt sugar moiety, d=a 2'-β-D-deoxyribosyl sugar moiety, and s=a phosphorothioate internucleoside linkage.

40. An oligomeric compound comprising a modified oligonucleotide according to the following chemical notation: $G_{ks}T_{ks}A_{ks}G_{ds}T_{ds}T_{ds}A_{ds}A_{ds}G_{ds}A_{ds}T_{ds}T_{ds}T_{ds}T_{ks}G_{ks}{}^{m}C_{k}$ (SEQ ID NO: 752), wherein:

A=an adenine nucleobase, ${}^{m}C$=a 5-methyl cytosine nucleobase,

G=a guanine nucleobase,
T=a thymine nucleobase,
k=a cEt sugar moiety,
d=a 2'-β-D-deoxyribosyl sugar moiety, and
s=a phosphorothioate internucleoside linkage.

41. An oligomeric compound comprising a modified oligonucleotide according to the following chemical notation: $A_{ks}{}^{m}C_{ks}A_{ks}{}^{m}C_{ds}G_{ds}A_{ds}G_{ds}T_{ds}A_{ds}T_{ds}A_{ds}T_{ds}T_{ds}A_{ks}G_{ks}G_{k}$ (SEQ ID NO: 609), wherein:
A=an adenine nucleobase,
${}^{m}C$=a 5-methyl cytosine nucleobase,
G=a guanine nucleobase,
T=a thymine nucleobase,
k=a cEt sugar moiety,
d=a 2'-β-D-deoxyribosyl sugar moiety, and
s=a phosphorothioate internucleoside linkage.

42. An oligomeric compound comprising a modified oligonucleotide according to the following chemical notation: $A_{ks}A_{ks}G_{ds}A_{ds}T_{ds}A_{ds}T_{ds}A_{ds}G_{ds}T_{ds}A_{ds}T_{ks}G_{es}G_{ks}T_{es}A_{k}$ (SEQ ID NO: 45), wherein:
A=an adenine nucleobase,
G=a guanine nucleobase,
T=a thymine nucleobase,
e=a 2'-MOE sugar moiety,
k=a cEt sugar moiety
d=a 2'-β-D-deoxyribosyl sugar moiety, and
s=a phosphorothioate internucleoside linkage.

43. An oligomeric compound comprising a modified oligonucleotide according to the following chemical notation: $A_{ks}{}^{m}C_{ks}G_{ds}A_{ds}G_{ds}T_{ds}A_{ds}T_{ds}A_{ds}T_{ds}T_{ds}A_{ks}G_{es}G_{ks}A_{es}A_{k}$ (SEQ ID NO: 737), wherein:
A=an adenine nucleobase,
${}^{m}C$=a 5-methyl cytosine nucleobase,
G=a guanine nucleobase,
T=a thymine nucleobase,
e=a 2'-MOE sugar moiety,
k=a cEt sugar moiety
d=a 2'-β-D-deoxyribosyl sugar moiety, and
s=a phosphorothioate internucleoside linkage.

44. An oligomeric compound comprising a modified oligonucleotide according to the following chemical notation: $A_{ks}A_{ks}A_{ds}G_{ds}A_{ds}T_{ds}A_{ds}T_{ds}A_{ds}G_{ds}T_{ds}A_{ks}T_{es}G_{ks}G_{es}T_{k}$ (SEQ ID NO: 120), wherein:
A=an adenine nucleobase,
G=a guanine nucleobase,
T=a thymine nucleobase,
e=a 2'-MOE sugar moiety,
k=a cEt sugar moiety
d=a 2'-β-D-deoxyribosyl sugar moiety, and
s=a phosphorothioate internucleoside linkage.

45. An oligomeric compound comprising a modified oligonucleotide according to the following chemical notation: ${}^{m}C_{ks}A_{ks}{}^{m}C_{ks}G_{ds}A_{ds}G_{ds}T_{ds}A_{ds}T_{ds}A_{ds}T_{ds}T_{ds}A_{ks}G_{ks}G_{ks}A_{e}$ (SEQ ID NO: 675), wherein:
A=an adenine nucleobase,
${}^{m}C$=a 5-methyl cytosine nucleobase,
G=a guanine nucleobase,
T=a thymine nucleobase,
e=a 2'-MOE sugar moiety,
k=a cEt sugar moiety
d=a 2'-β-D-deoxyribosyl sugar moiety, and
s=a phosphorothioate internucleoside linkage.

46. The oligomeric compound of any of embodiments 1-45, wherein the oligomeric compound comprises a conjugate group.

47. The oligomeric compound of embodiment 46, wherein the conjugate group comprises a conjugate linker and a conjugate moiety.

48. The oligomeric compound of embodiment 46 or 47, wherein the conjugate linker consists of a single bond.

49. The oligomeric compound of any of embodiments 46-48, wherein the conjugate linker is cleavable.

50. The oligomeric compound of any of embodiments 46-49, wherein the conjugate linker comprises 1-3 linker-nucleosides.

51. The oligomeric compound of any of embodiments 46-49, wherein the conjugate linker does not comprise any linker nucleosides.

52. The oligomeric compound of any of embodiments 46-51, wherein the conjugate group is attached to the modified oligonucleotide at the 5'-end of the modified oligonucleotide.

53. The oligomeric compound of any of embodiments 46-51, wherein the conjugate group is attached to the modified oligonucleotide at the 3'-end of the modified oligonucleotide.

54. The oligomeric compound of any of embodiments 46-53, wherein the conjugate group comprises a C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, C12 alkenyl, C11 alkenyl, C9 alkenyl, C8 alkenyl, C7 alkenyl, C6 alkenyl, or C5 alkenyl.

55. The oligomeric compound of any of embodiments 46-54, wherein the conjugate moiety is a 6-palmitamidohexyl conjugate moiety.

56. The oligomeric compound of any of embodiments 46-53, wherein the conjugate group has the following structure:

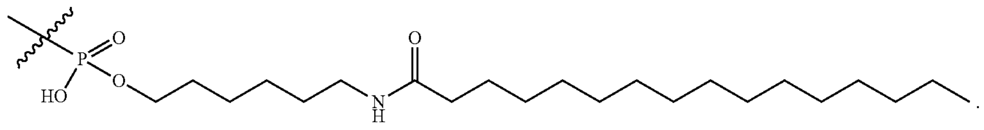

57. The oligomeric compound of any of embodiments 46-56, wherein the conjugate group comprises a cell-targeting moiety.

58. The oligomeric compound of embodiment 57, wherein the cell-targeting moiety has an affinity for TfR1.

59. The oligomeric compound of embodiment 58, wherein the cell-targeting moiety comprises an anti-TfR1 antibody or fragment thereof.

60. The oligomeric compound of embodiment 58, wherein the cell-targeting moiety comprises a protein or peptide capable of binding TfR1.

61. The oligomeric compound of embodiment 58, wherein the cell-targeting moiety comprises an aptamer capable of binding TfR1.

62. An oligomeric compound comprising a modified oligonucleotide according to the following chemical notation: $[C16\text{-}HA]_{o}A_{ks}A_{ks}G_{ds}A_{ds}T_{ds}A_{ds}T_{ds}A_{ds}G_{ds}T_{ds}A_{ds}T_{ks}G_{es}G_{ks}T_{es}A_{k}$ (SEQ ID NO: 45), wherein:

A=an adenine nucleobase,

G=a guanine nucleobase,

T=a thymine nucleobase, e=a 2'-MOE sugar moiety, k=a cEt sugar moiety d=a 2'-β-D-deoxyribosyl sugar moiety, o=a phosphodiester internucleoside linkage, s=a phosphorothioate internucleoside linkage, and

[C16 - HA] =

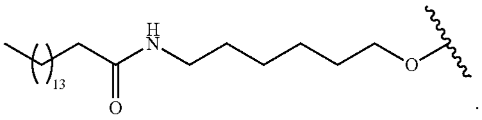

.

63. An oligomeric compound comprising a modified oligonucleotide according to the following chemical notation: $[C16\text{-}HA]_{c}A_{ks}{}^{m}C_{ks}A_{ks}{}^{m}C_{ds}G_{ds}A_{ds}G_{ds}T_{ds}A_{ds}T_{ds}A_{ds}T_{ds}T_{ds}A_{ks}G_{ks}G_{k}$ (SEQ ID NO: 609), wherein:

A=an adenine nucleobase, $^{m}$C=a 5-methyl cytosine nucleobase,

G=a guanine nucleobase,

T=a thymine nucleobase, k=a cEt sugar moiety d=a 2'-β-D-deoxyribosyl sugar moiety, o=a phosphodiester internucleoside linkage, s=a phosphorothioate internucleoside linkage, and

[C16 - HA] =

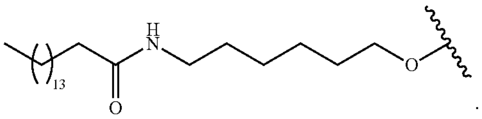

.

64. An oligomeric compound comprising a modified oligonucleotide according to the following chemical notation: $[C16\text{-}HA]_{o}G_{ks}T_{ks}A_{ks}G_{ds}T_{ds}T_{ds}A_{ds}A_{ds}G_{ds}A_{ds}T_{ds}T_{ds}T_{ds}T_{ks}G_{ks}{}^{m}C_{k}$ (SEQ ID NO: 752), wherein:

A=an adenine nucleobase, $^{m}$C=a 5-methyl cytosine nucleobase,

G=a guanine nucleobase,

T=a thymine nucleobase, k=a cEt sugar moiety d=a 2'-β-D-deoxyribosyl sugar moiety, o=a phosphodiester internucleoside linkage, s=a phosphorothioate internucleoside linkage, and

[C16 - HA] =

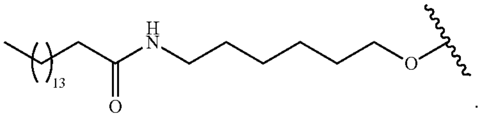

.

65. An oligomeric compound comprising a modified oligonucleotide according to the following chemical notation: $[C16\text{-}HA]_{o}A_{ks}A_{ks}A_{ds}G_{ds}A_{ds}T_{ds}A_{ds}T_{ds}A_{ds}G_{ds}T_{ds}A_{ks}T_{es}G_{ks}G_{es}T_{k}$ (SEQ ID NO: 120), wherein:

A=an adenine nucleobase,

G=a guanine nucleobase,

T=a thymine nucleobase, e=a 2'-MOE sugar moiety, k=a cEt sugar moiety d=a 2'-β-D-deoxyribosyl sugar moiety, o=a phosphodiester internucleoside linkage, s=a phosphorothioate internucleoside linkage, and

[C16 - HA] =

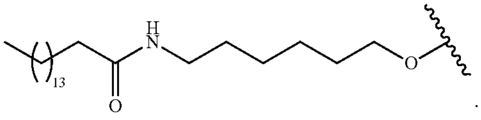

.

66. The oligomeric compound of any of embodiments 1 to 65, wherein the oligomeric compound comprises a terminal group.

67. The oligomeric compound of embodiment 66, wherein the terminal group is an abasic sugar moiety.

68. An oligomeric compound according to the following chemical structure:

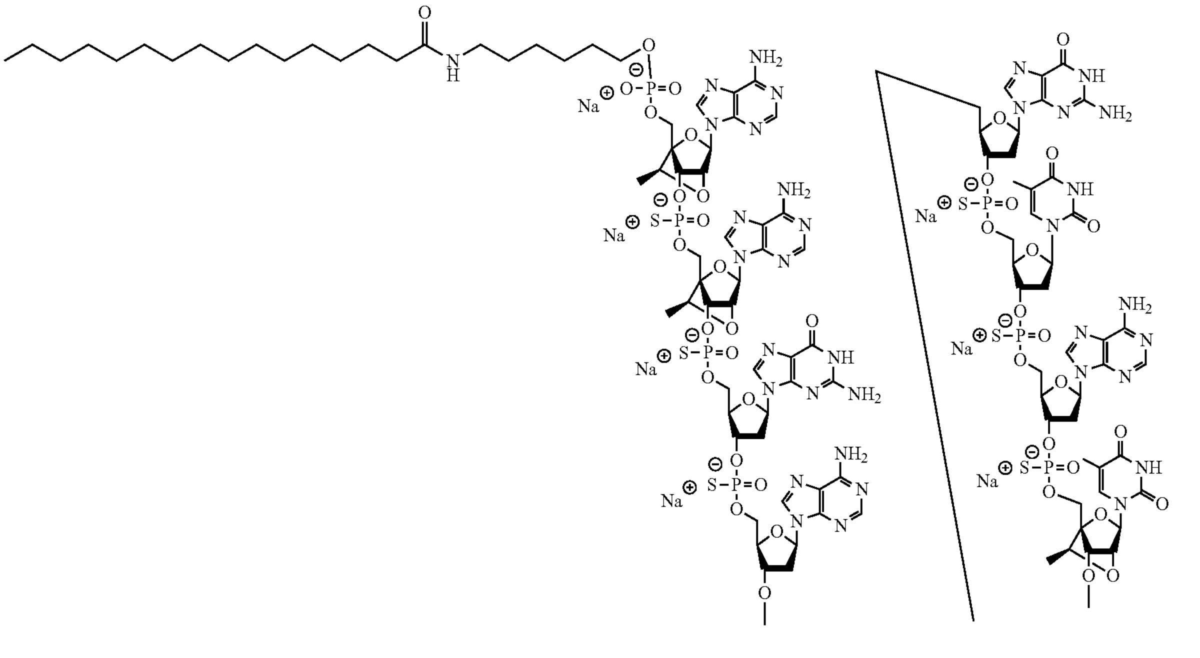
(SEQ ID NO: 45)
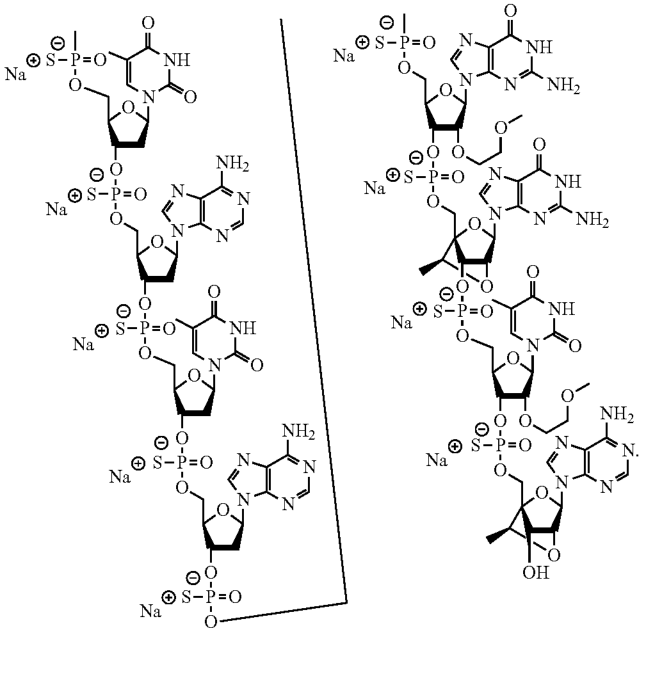

69. An oligomeric compound according to the following chemical structure:
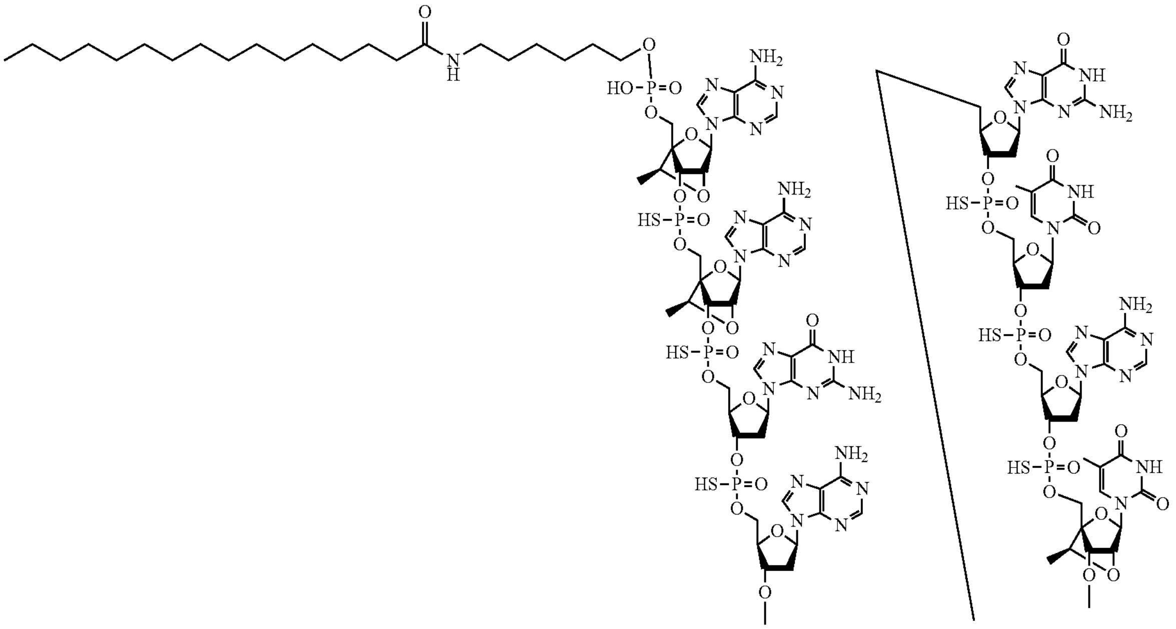
(SEQ ID NO: 45)
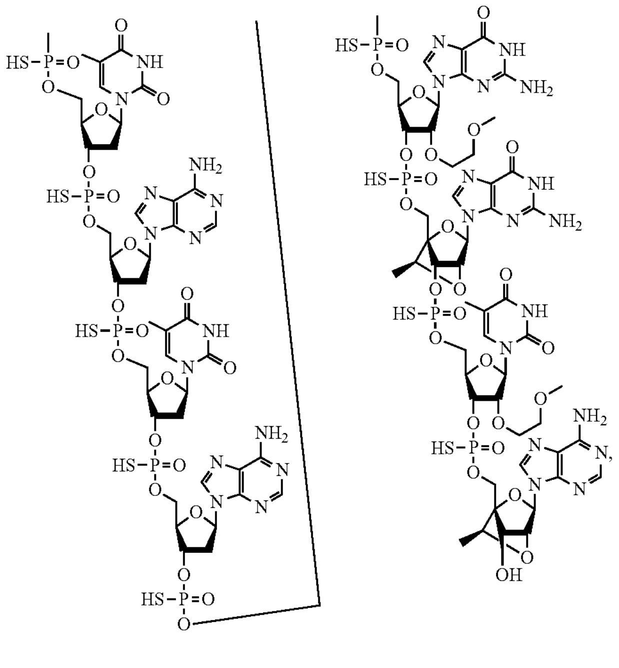
or a salt thereof.

70. The oligomeric compound of embodiment 69, which is the sodium salt or potassium salt.
71. An oligomeric compound according to the following chemical structure:
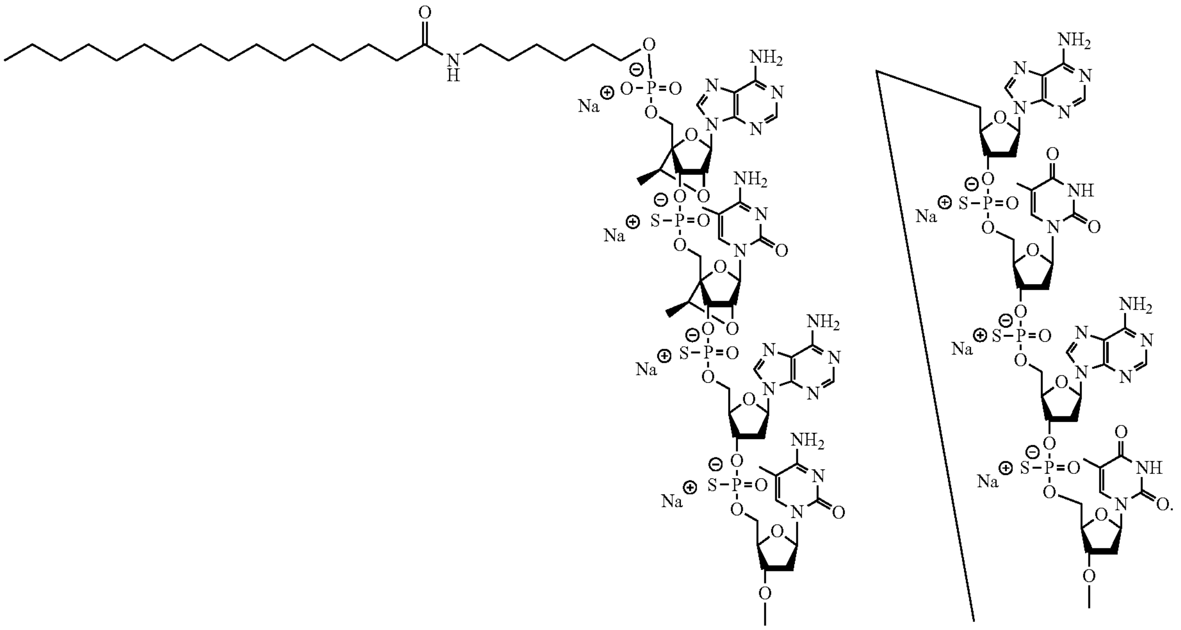
(SEQ ID NO: 609)
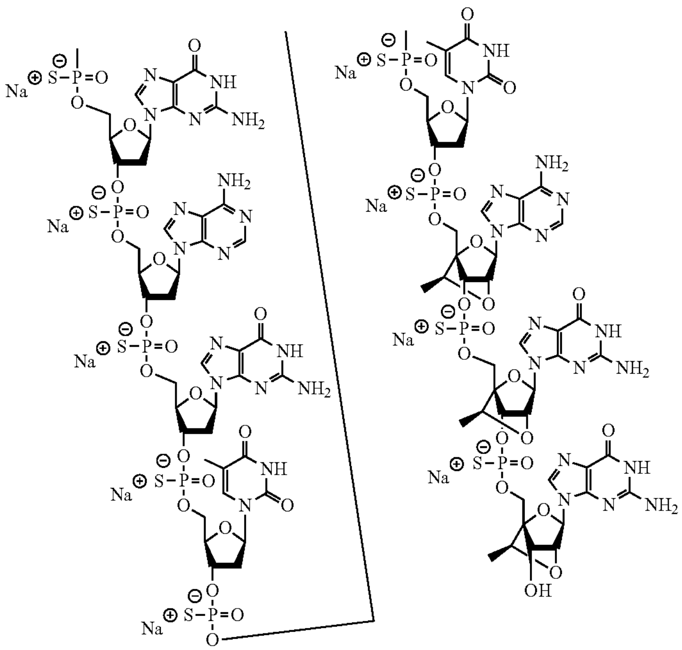

72. An oligomeric compound according to the following chemical structure:
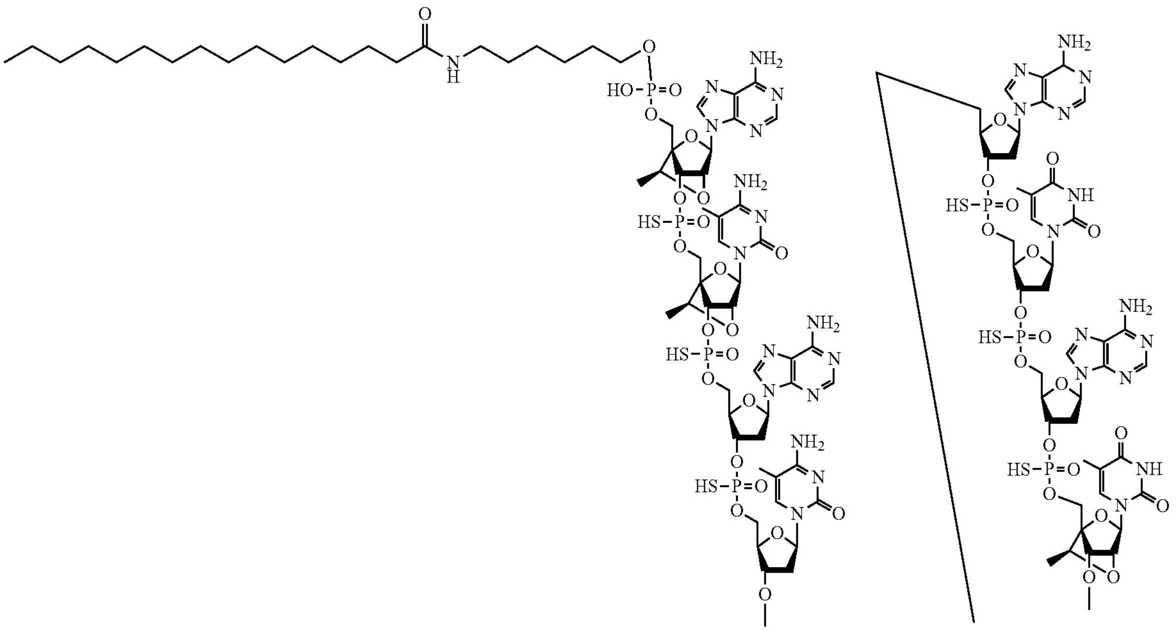
(SEQ ID NO: 609)
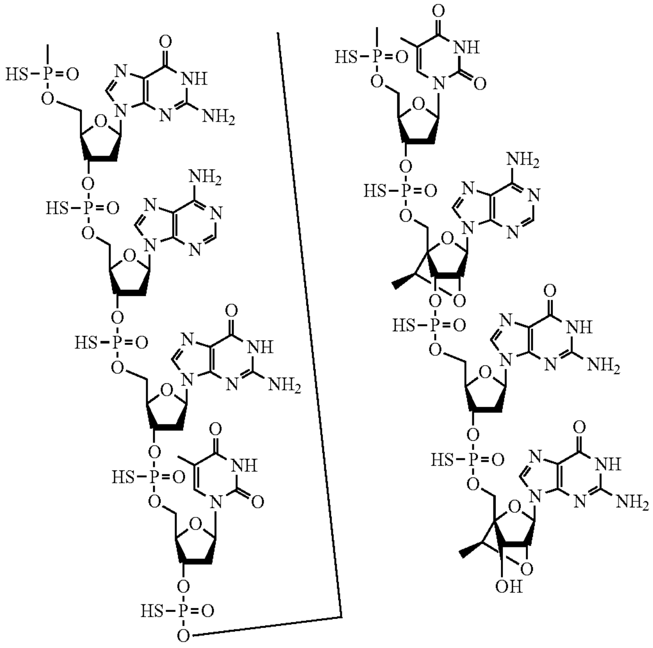
or a salt thereof.

73. The oligomeric compound of embodiment 72, which is the sodium salt or potassium salt.
74. An oligomeric compound according to the following chemical structure:
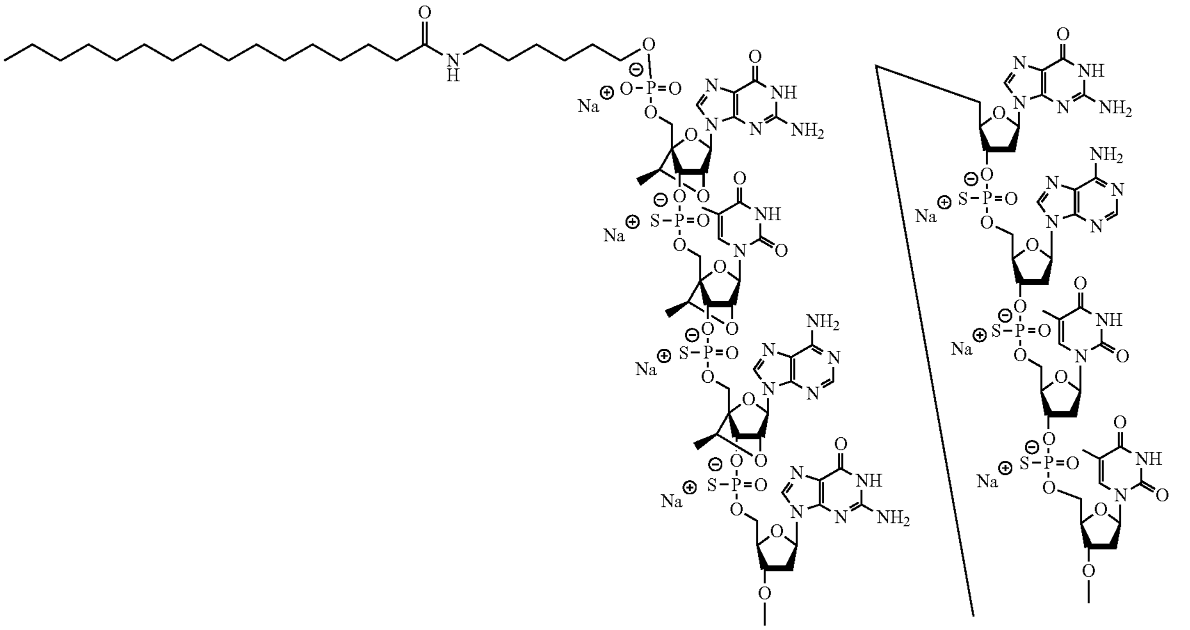
(SEQ ID NO: 752)
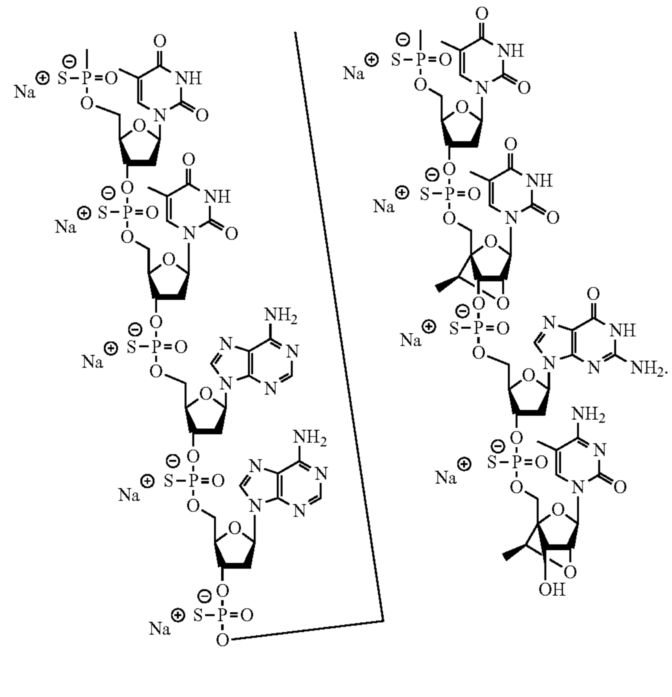

75. An oligomeric compound according to the following chemical structure:
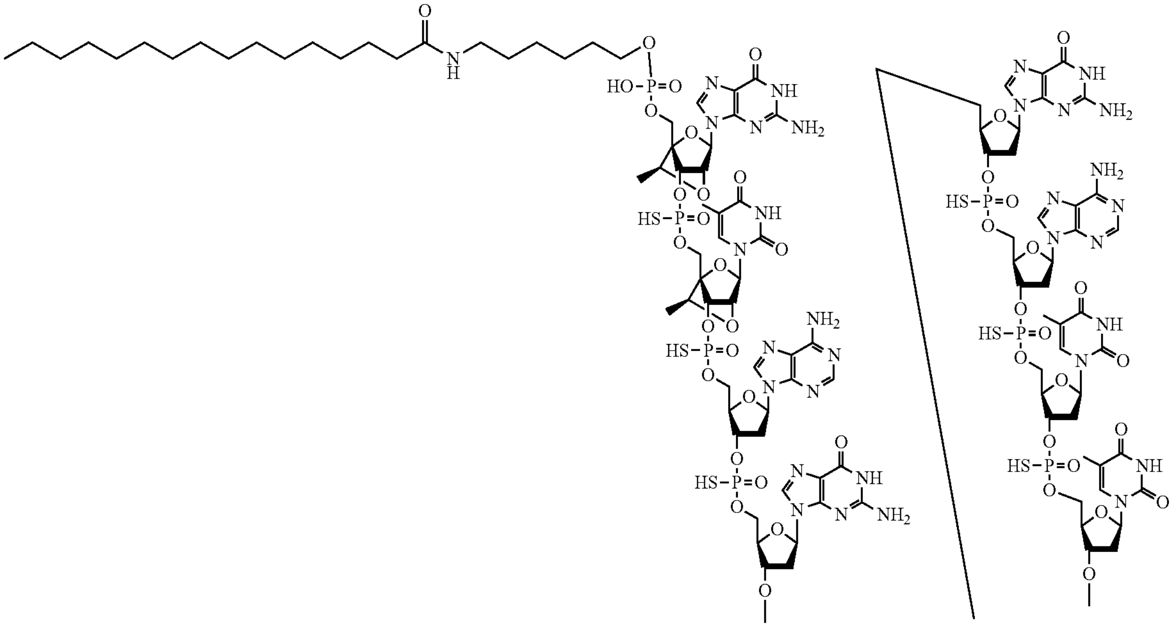
(SEQ ID NO: 752)
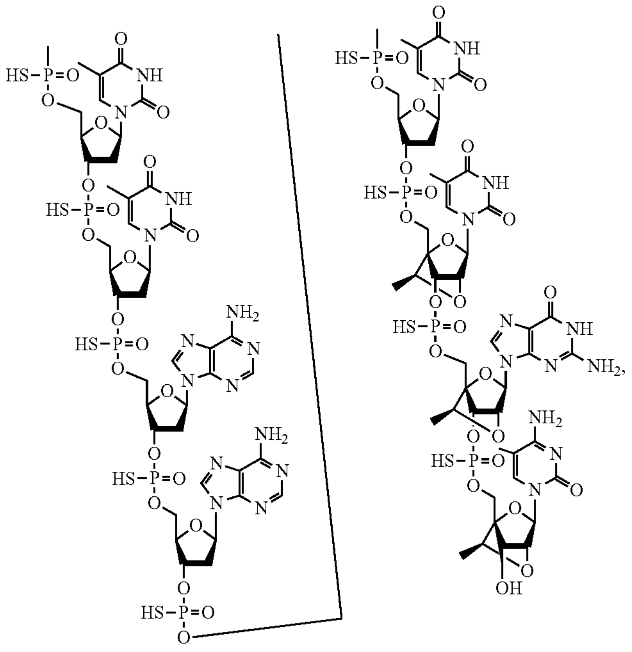
or a salt thereof.

76. The oligomeric compound of embodiment 75, which is the sodium salt or potassium salt.
77. An oligomeric compound according to the following chemical structure:
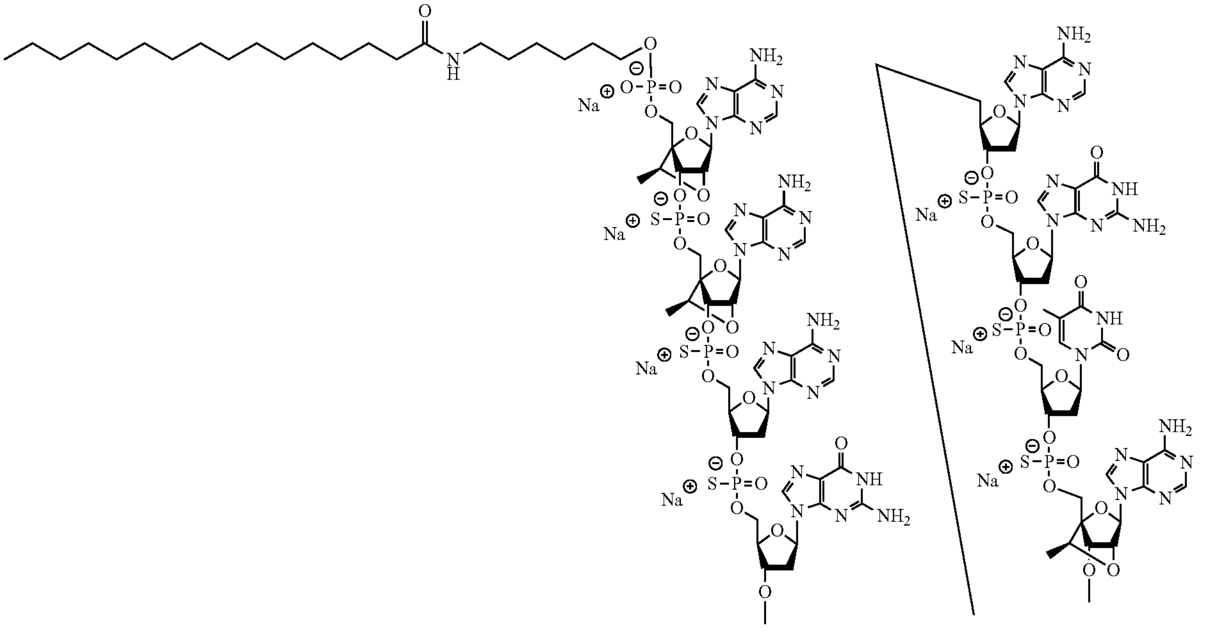
(SEQ ID NO: 120)
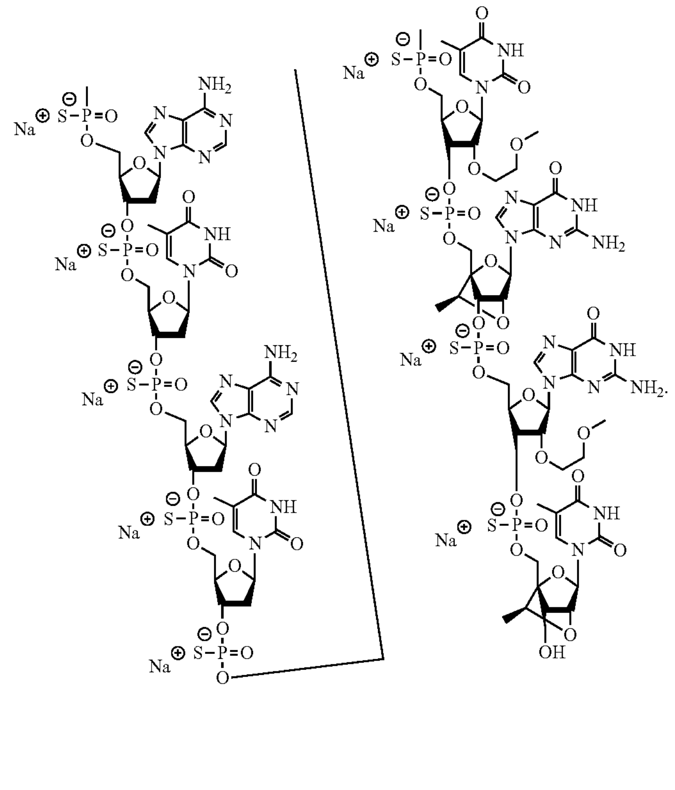

78. An oligomeric compound according to the following chemical structure:
(SEQ ID NO: 120)
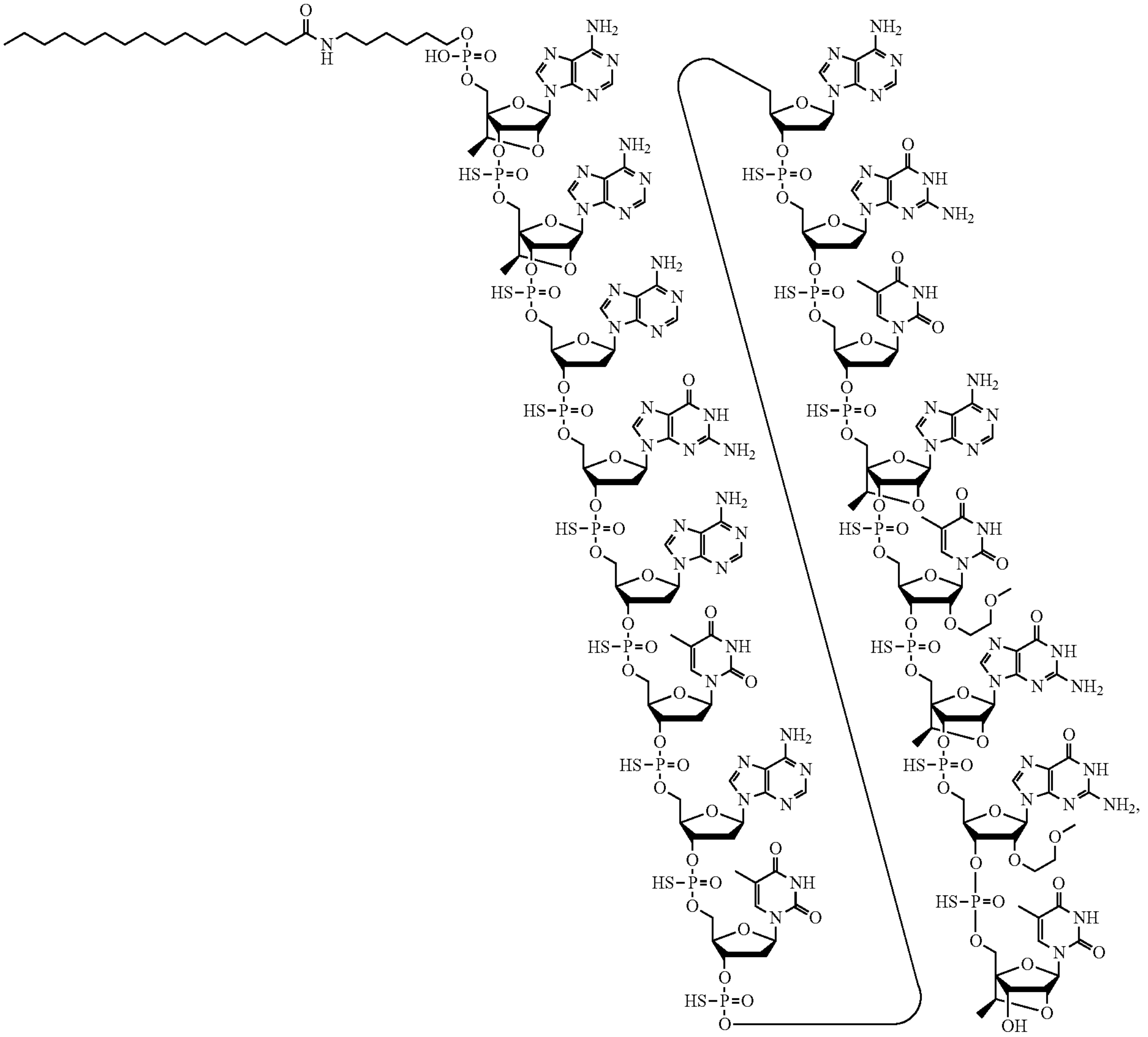
or a salt thereof.

79. The oligomeric compound of embodiment 78, which is the sodium salt or potassium salt.
80. A modified oligonucleotide according to the following chemical structure:
(SEQ ID NO: 185)
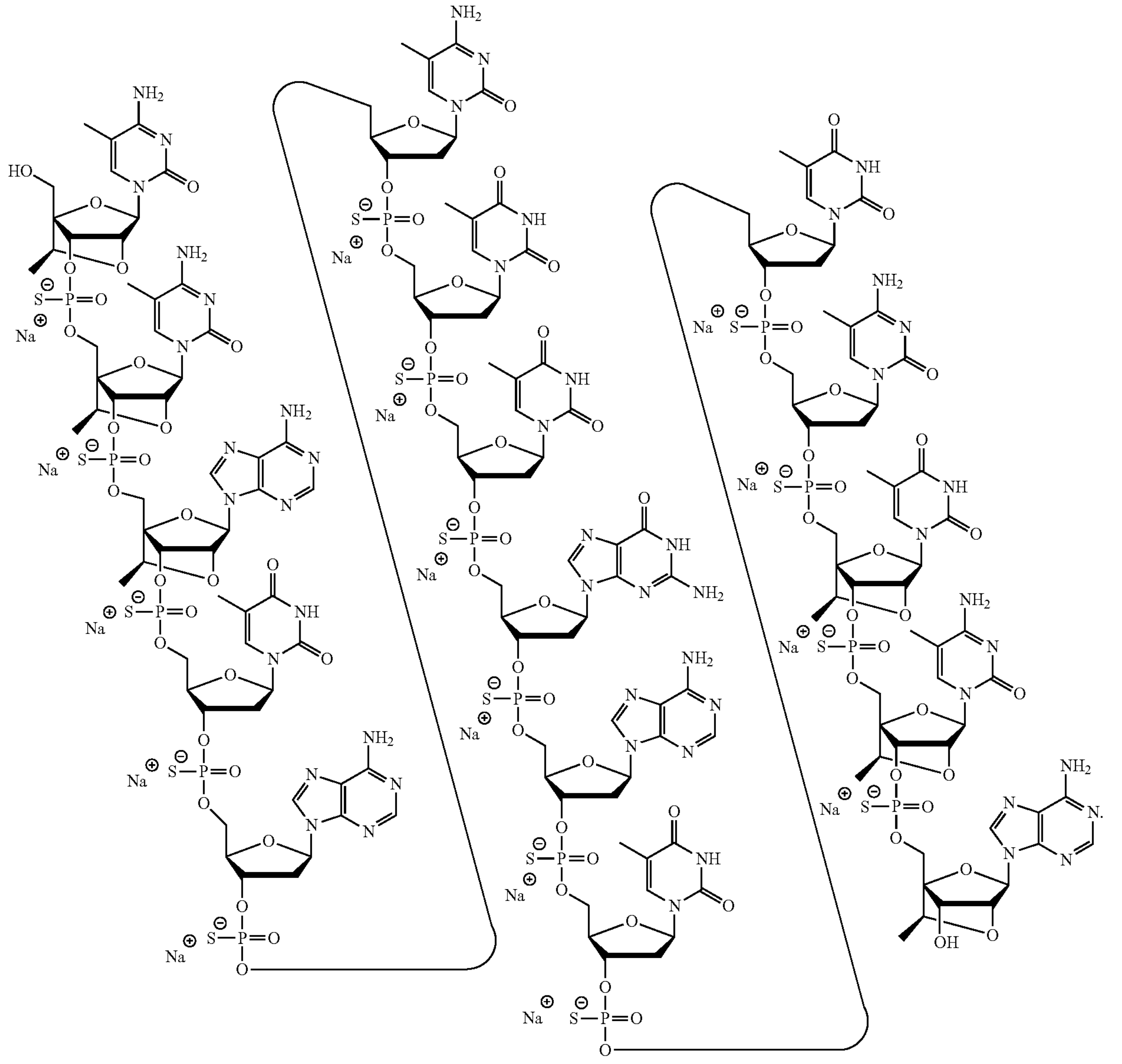

81. A modified oligonucleotide according to the following chemical structure:
(SEQ ID NO: 185)
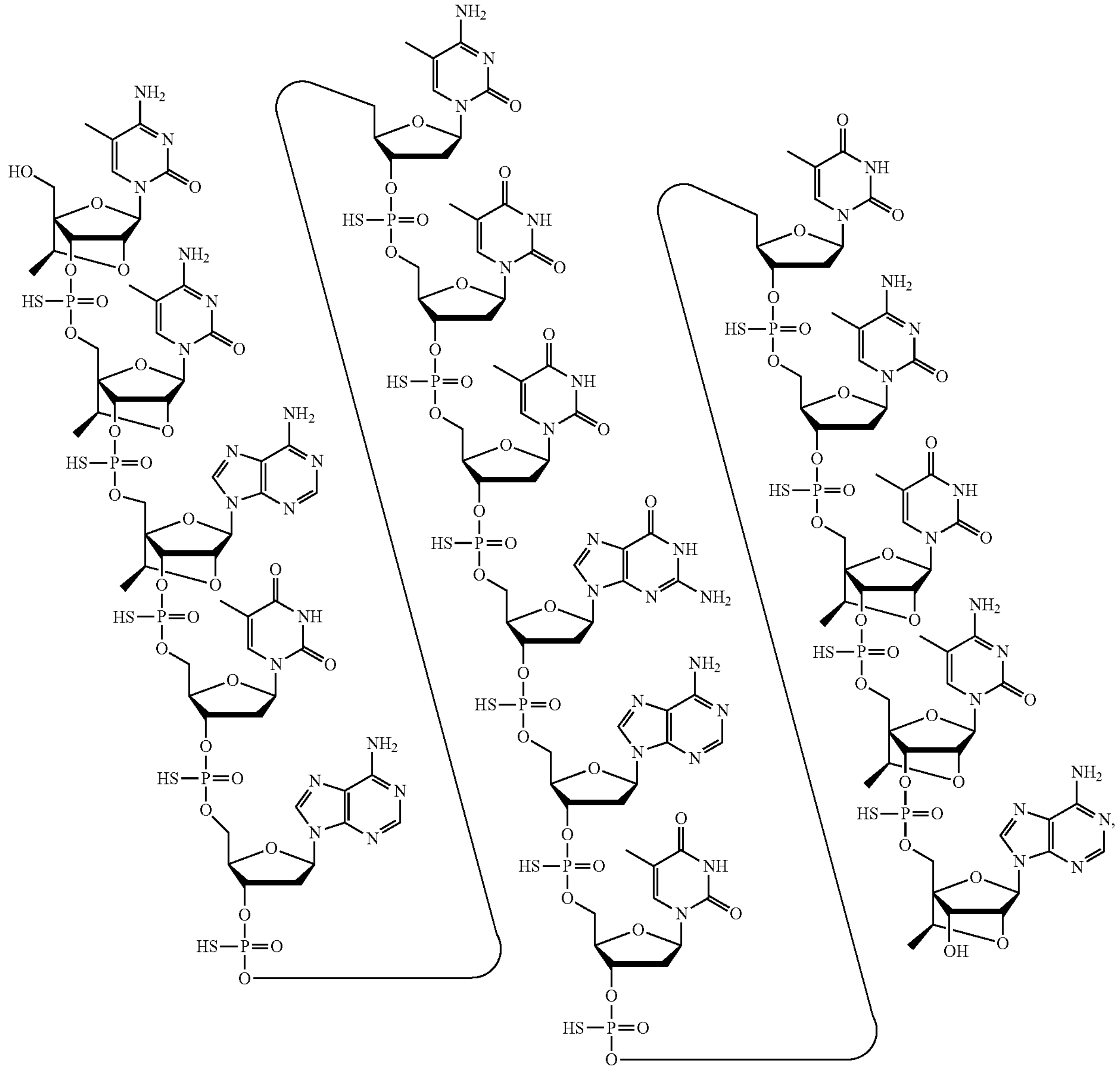
or a salt thereof.

82. The modified oligonucleotide of embodiment 81, which is the sodium salt or potassium salt.
83. A modified oligonucleotide according to the following chemical structure:
(SEQ ID NO: 752)
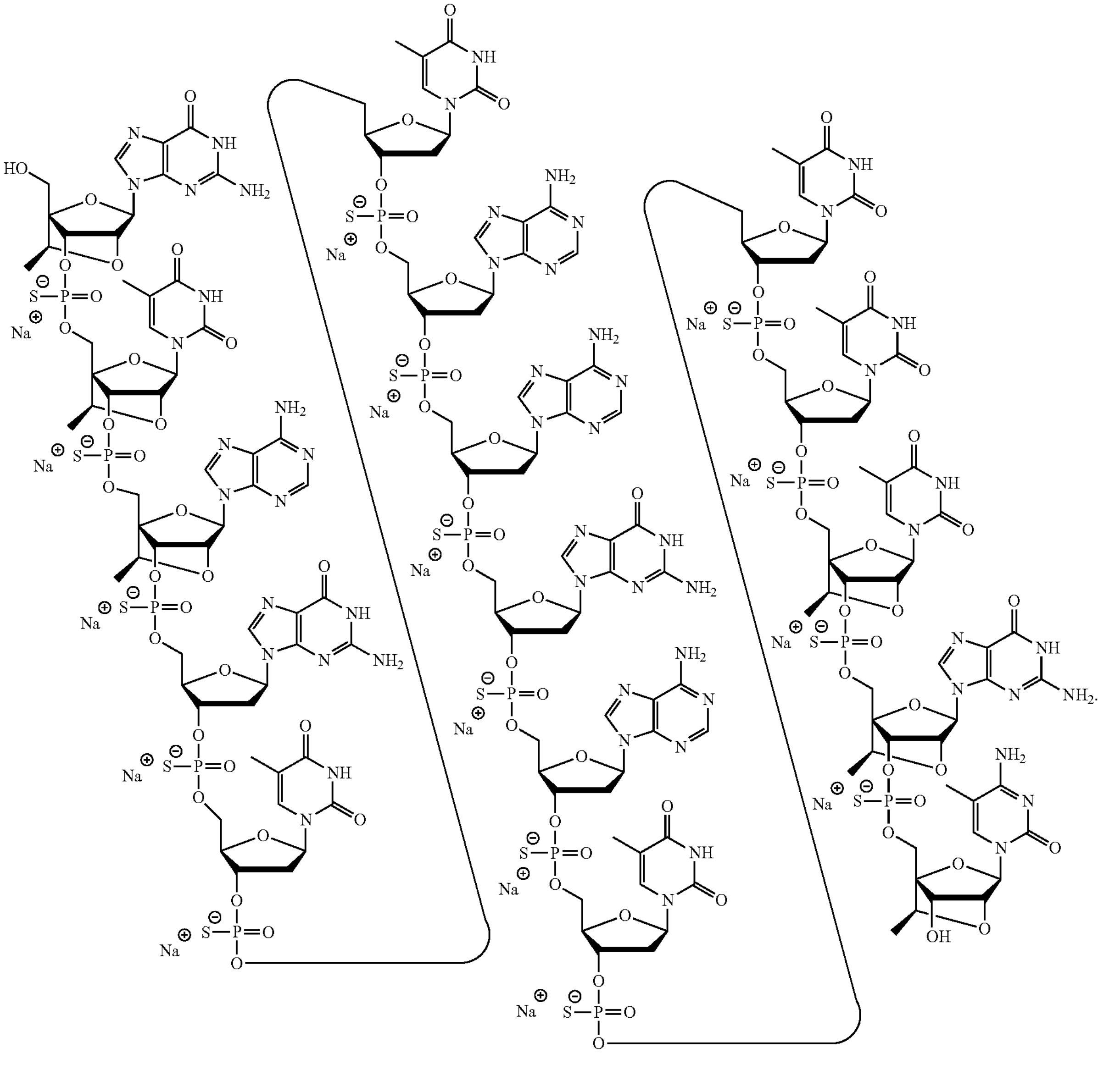

84. A modified oligonucleotide according to the following chemical structure:
(SEQ ID NO: 752)
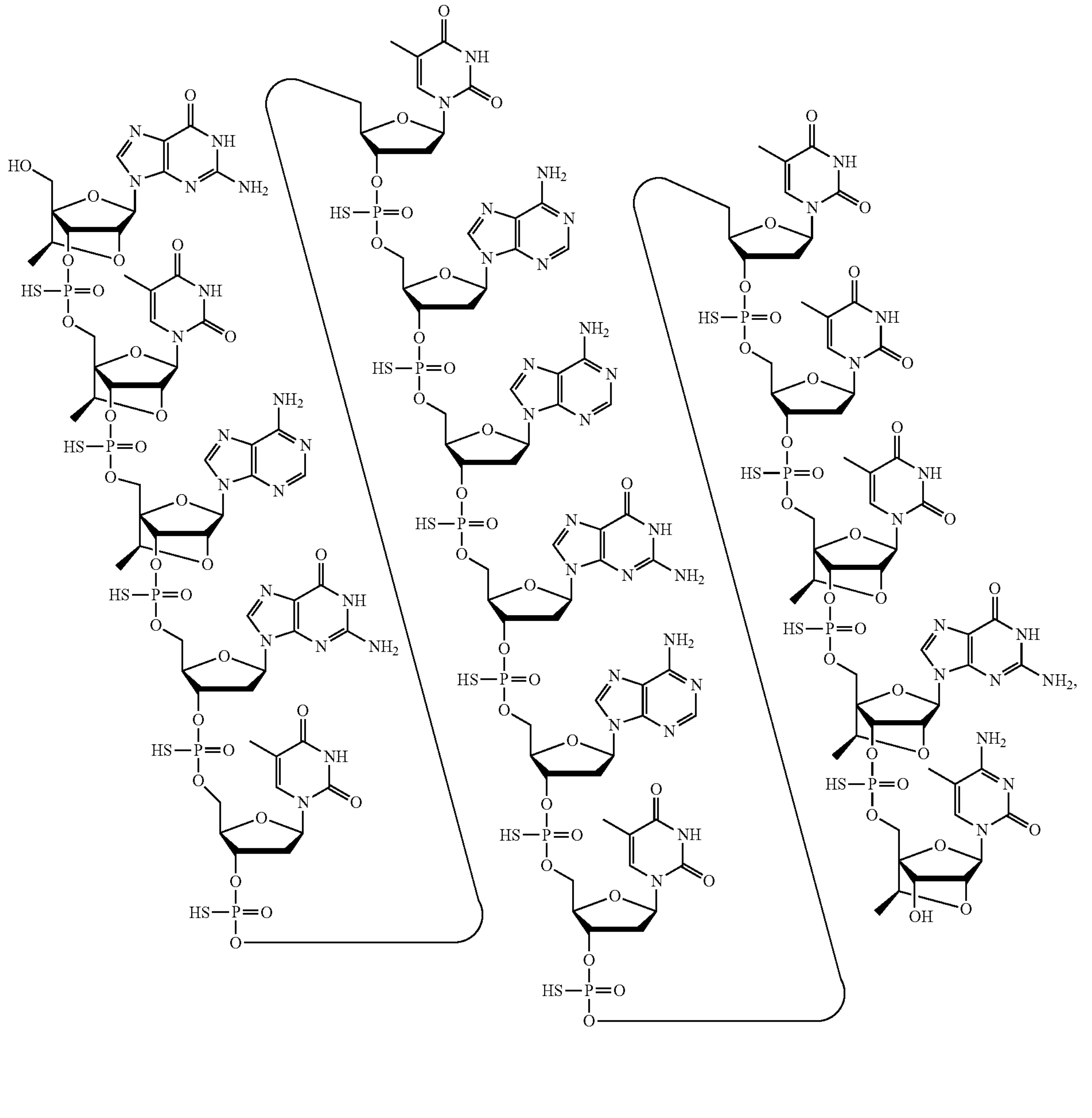
for a salt thereof.

85. The modified oligonucleotide of embodiment 84, which is the sodium salt or potassium salt.
86. A modified oligonucleotide according to the following chemical structure:
(SEQ ID NO: 609)
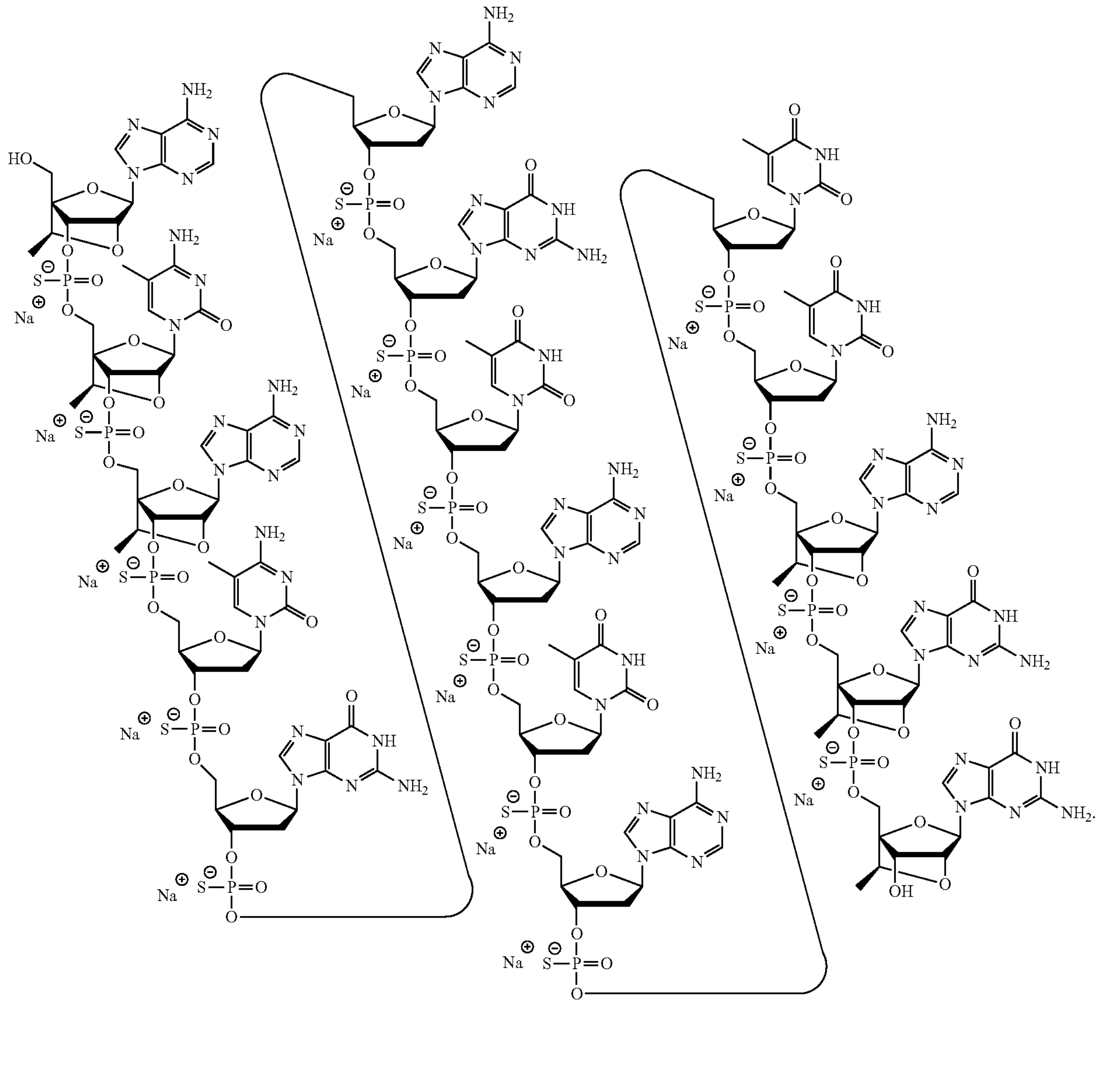

87. A modified oligonucleotide according to the following chemical structure:
(SEQ ID NO: 609)
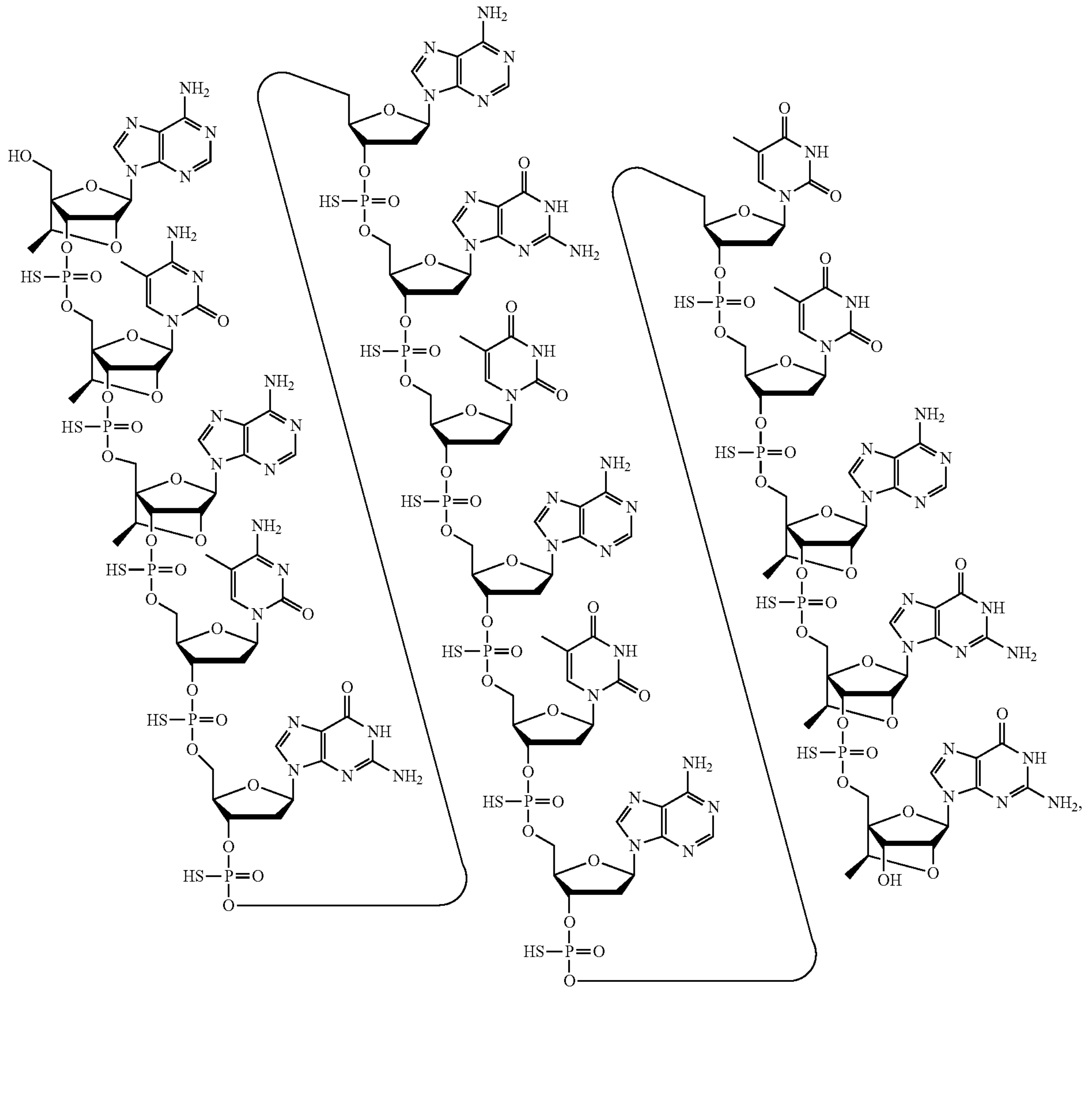
or a salt thereof.

88. The modified oligonucleotide of embodiment 87, which is the sodium salt or potassium salt.
89. A modified oligonucleotide according to the following chemical structure:
(SEQ ID NO: 45)
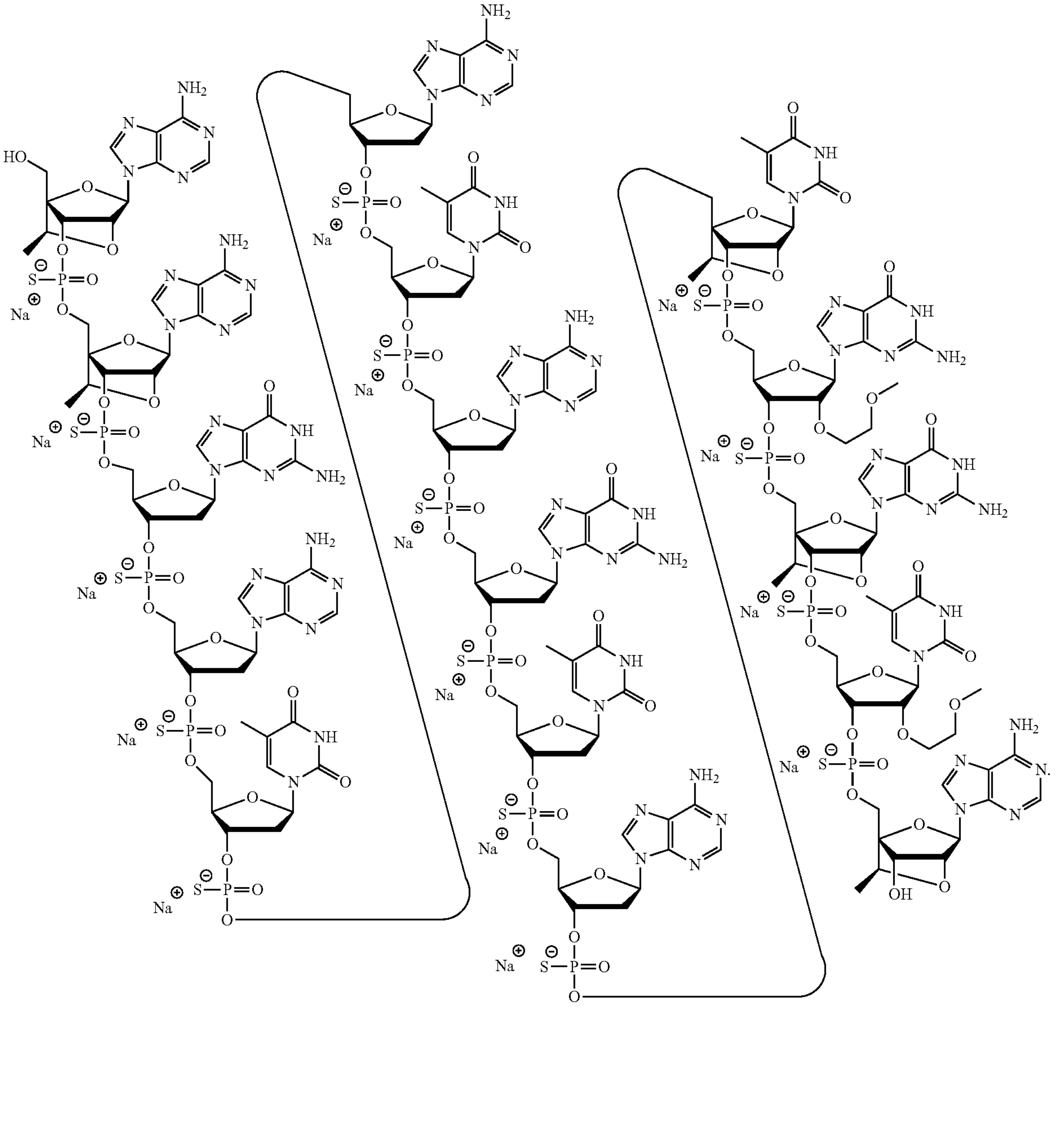

90. A modified oligonucleotide according to the following chemical structure:
(SEQ ID NO: 45)
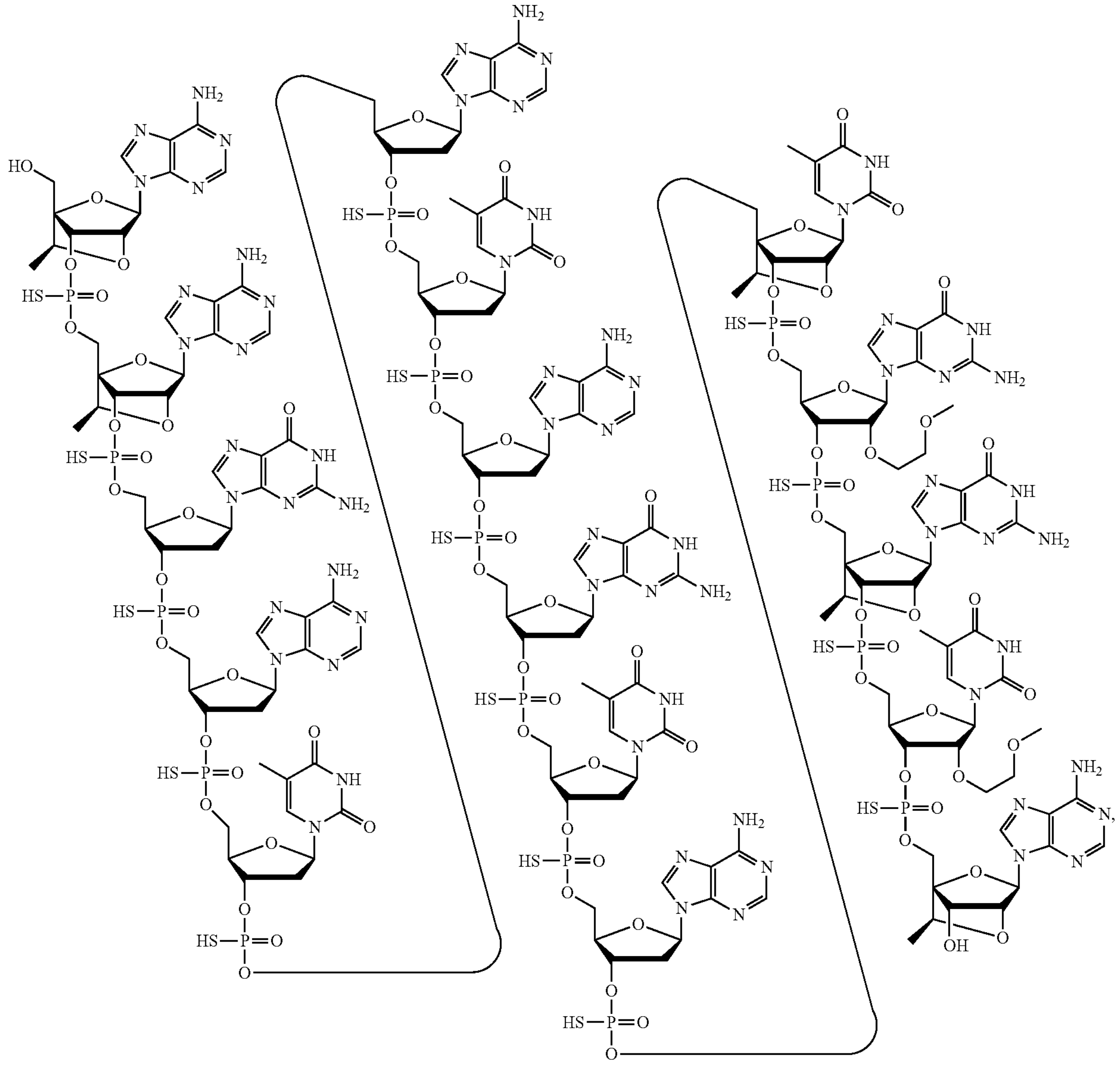
or a salt thereof.

91. The modified oligonucleotide of embodiment 90, which is the sodium salt or potassium salt.
92. A modified oligonucleotide according to the following chemical structure:
(SEQ ID NO: 737)
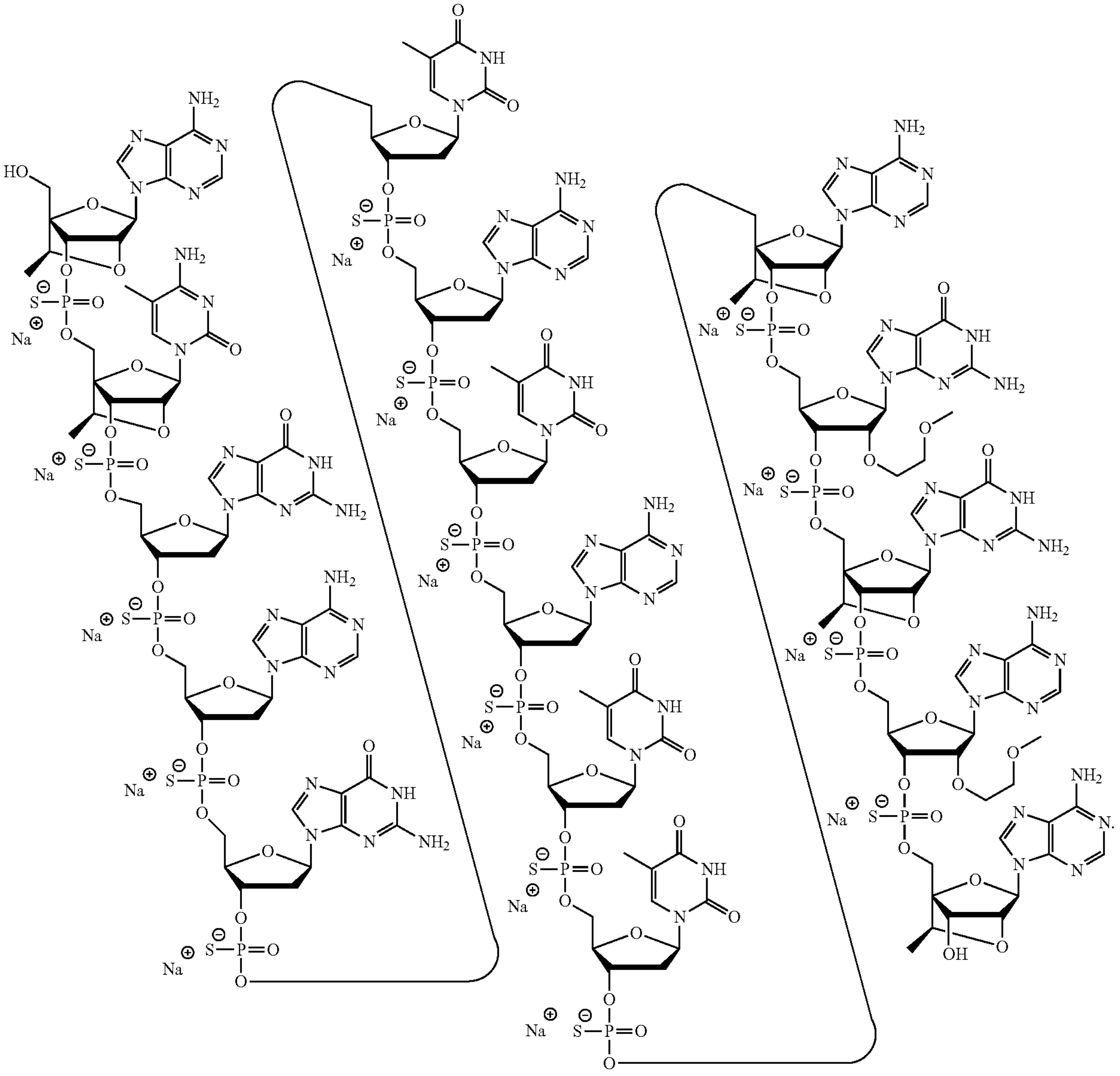

93. A modified oligonucleotide according to the following chemical structure:
(SEQ ID NO: 737)
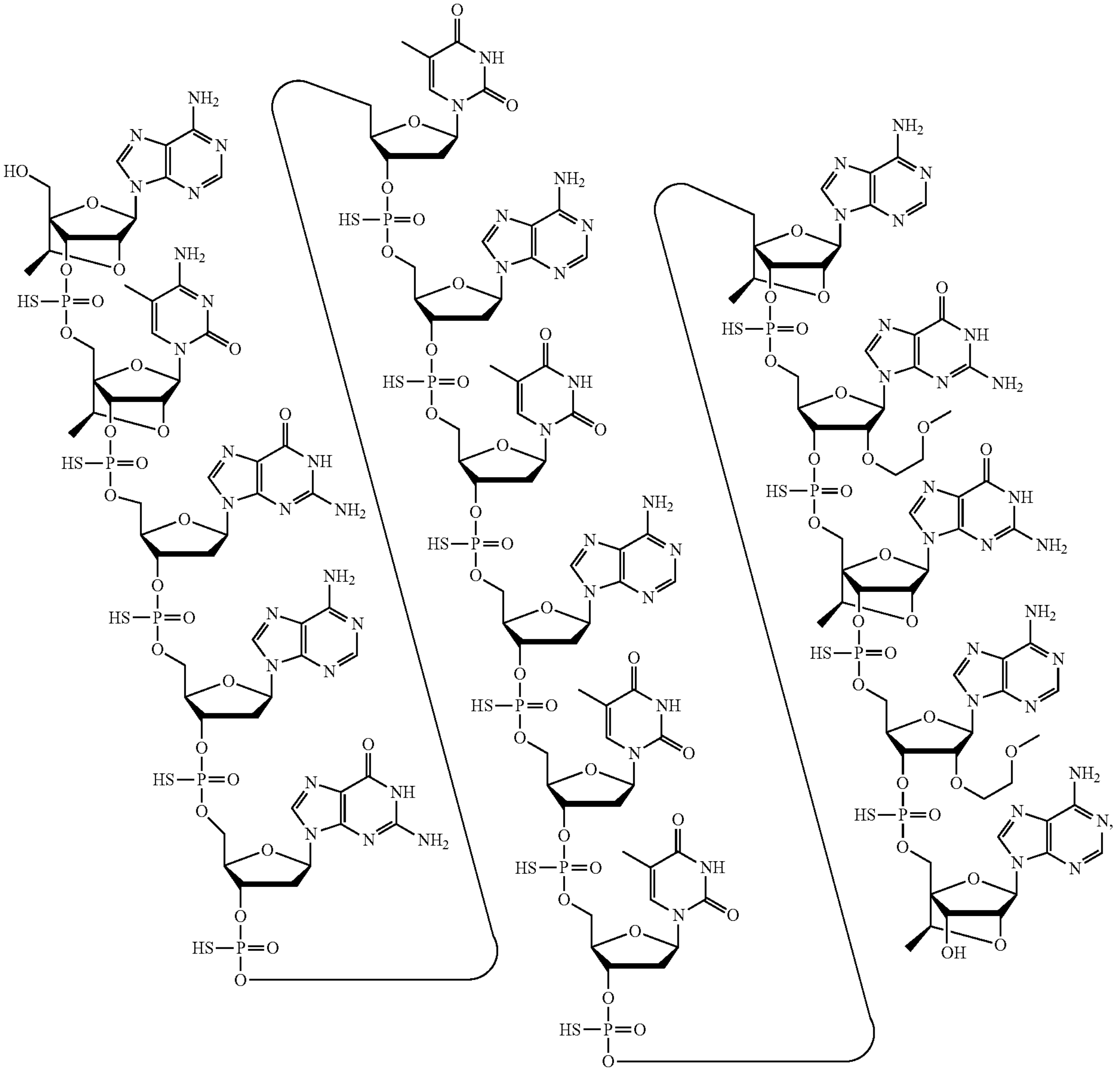
or a salt thereof.

94. The modified oligonucleotide of embodiment 93, which is the sodium salt or potassium salt.
95. A modified oligonucleotide according to the following chemical structure:
(SEQ ID NO: 120)
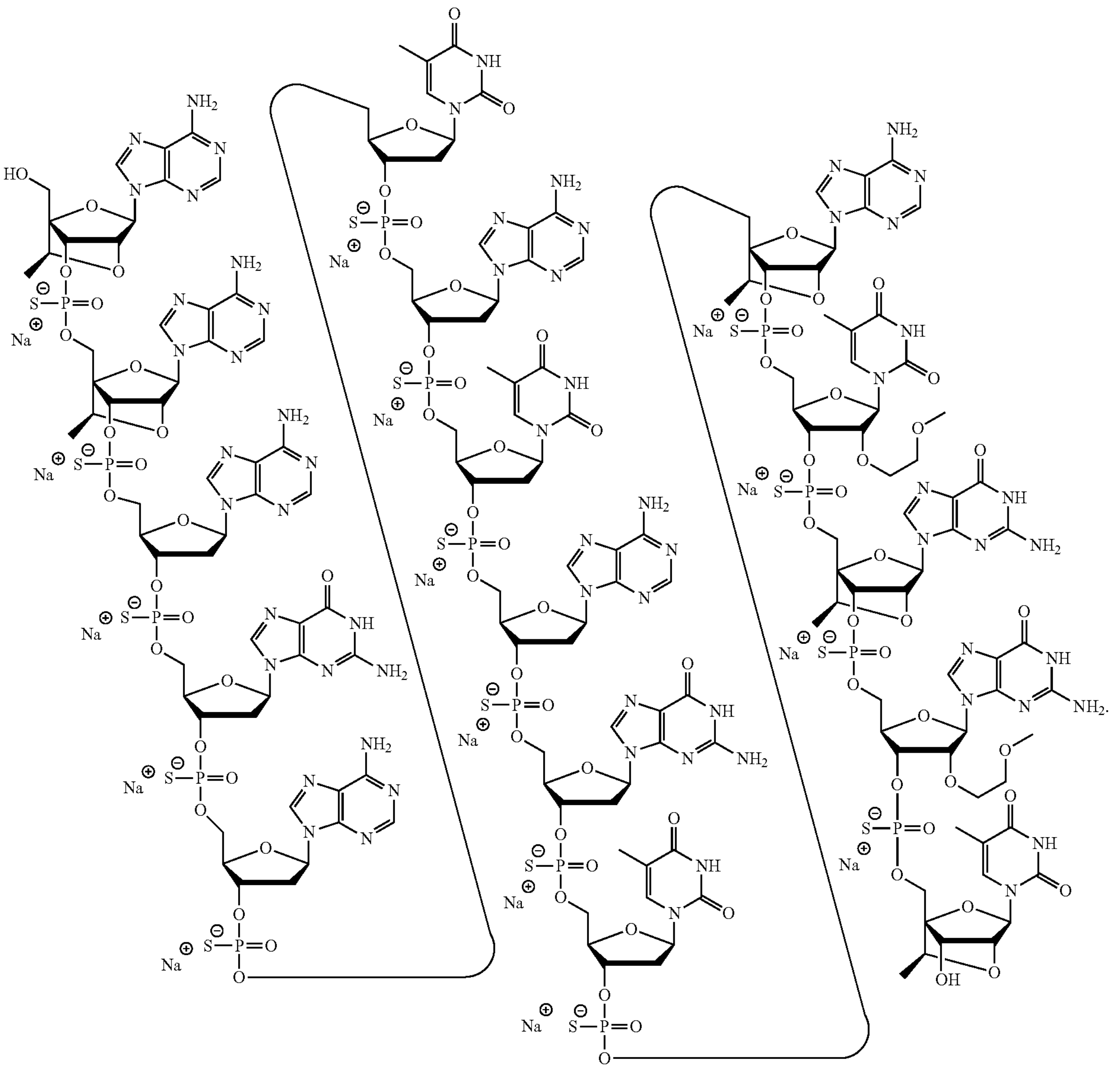

96. A modified oligonucleotide according to the following chemical structure:
(SEQ ID NO: 120)
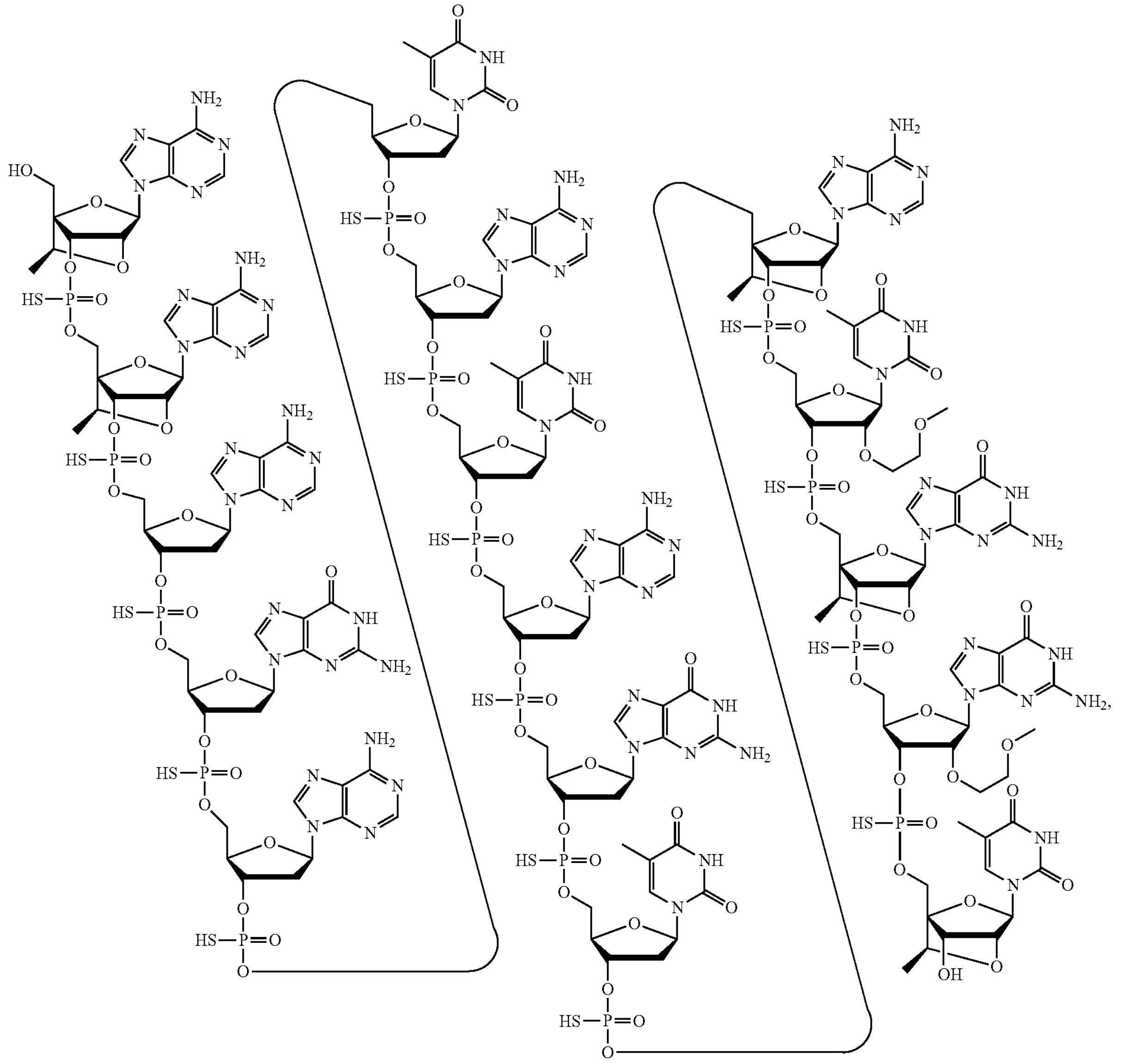
or a salt thereof.

97. The modified oligonucleotide of embodiment 96, which is the sodium salt or potassium salt.
98. A modified oligonucleotide according to the following chemical structure:
(SEQ ID NO: 675)
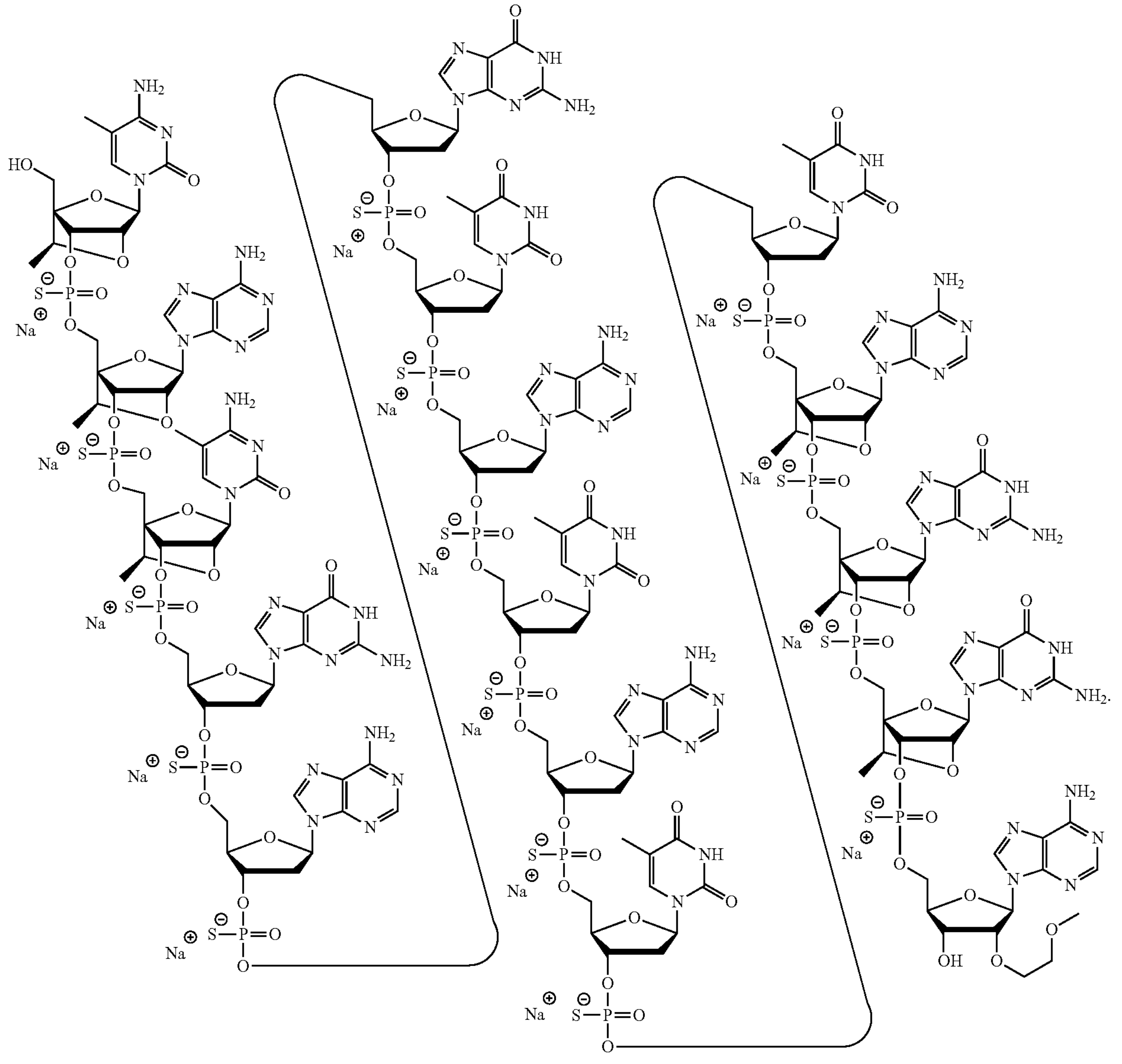

99. A modified oligonucleotide according to the following chemical structure:

(SEQ ID NO: 675)

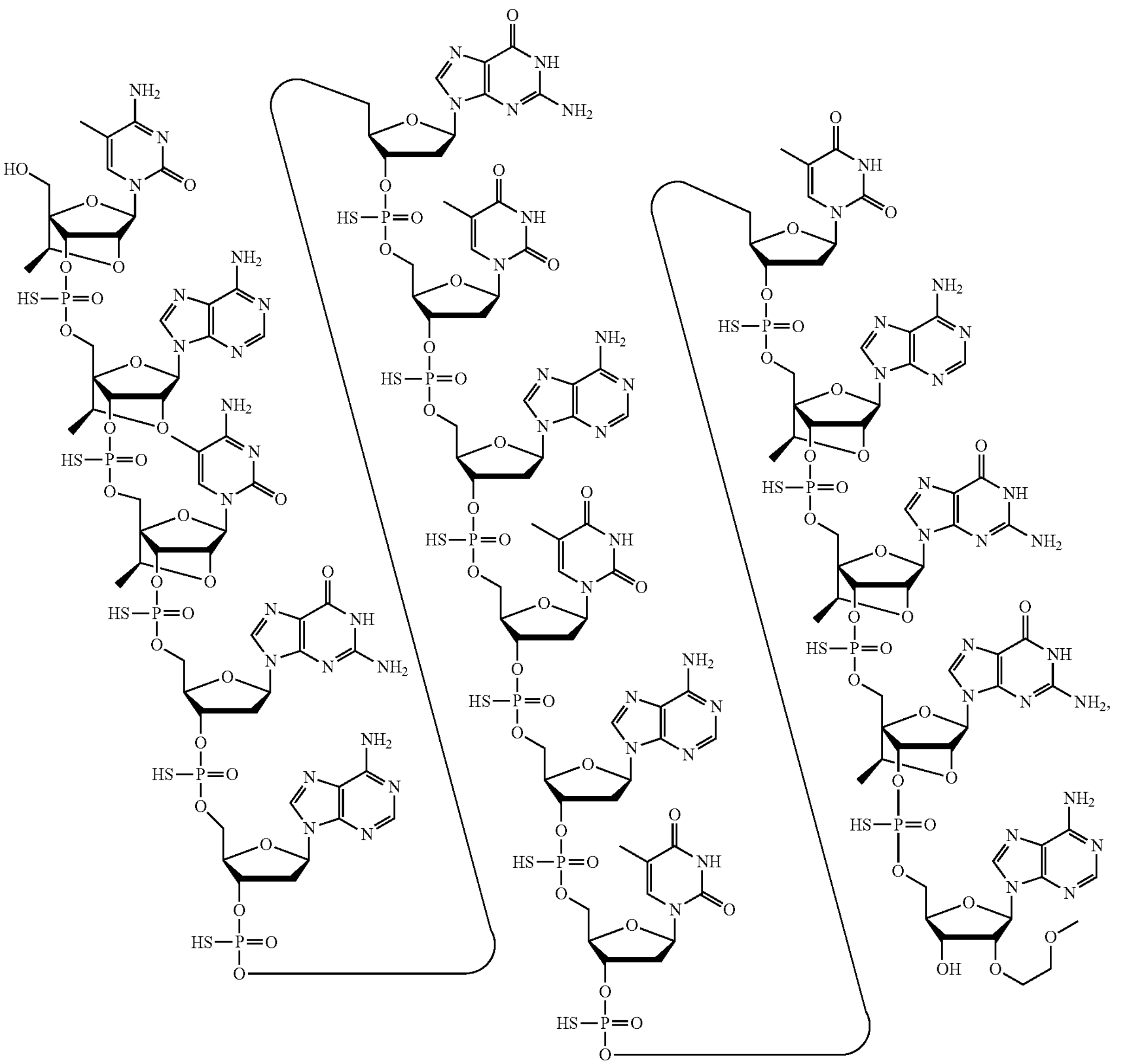

or a salt thereof.

100. The modified oligonucleotide of embodiment 99, which is the sodium salt or potassium salt.

101. A chirally enriched population of oligomeric compounds of any of embodiments 1-79 or modified oligonucleotide of embodiments 80-100, wherein the population is enriched for modified oligonucleotides comprising at least one particular phosphorothioate internucleoside linkage having a particular stereochemical configuration.

102. The chirally enriched population of embodiment 101, wherein the population is enriched for modified oligonucleotides comprising at least one particular phosphorothioate internucleoside linkage having the (Sp) or (Rp) configuration.

103. The chirally enriched population of embodiment 101, wherein the population is enriched for modified oligonucleotides having a particular, independently selected stereochemical configuration at each phosphorothioate internucleoside linkage.

104. The chirally enriched population of embodiment 101, wherein the population is enriched for modified oligonucleotides having the (Rp) configuration at one particular phosphorothioate internucleoside linkage and the (Sp) configuration at each of the remaining phosphorothioate internucleoside linkages.

105. The chirally enriched population of embodiment 101, wherein the population is enriched for modified oligonucleotides having at least 3 contiguous phosphorothioate internucleoside linkages in the Sp, Sp, and Rp configurations, in the 5' to 3' direction.

106. A population of oligomeric compounds comprising the modified oligonucleotides of any of embodiments 1-79, or a population of modified oligonucleotides of embodiments 80-100, wherein all of the phosphorothioate internucleoside linkages of the modified oligonucleotide are stereorandom.

107. An oligomeric duplex, comprising a first oligomeric compound and a second oligomeric compound comprising a second modified oligonucleotide, wherein the first oligomeric compound is an oligomeric compound of any of embodiments 1-59.

108. The oligomeric duplex of embodiment 107, wherein the second oligomeric compound comprises a second modified oligonucleotide consisting of 8 to 80 linked nucleosides, and wherein the nucleobase sequence of the second modified oligonucleotide comprises a complementary region of at least 8 nucleobases that is at least 90% complementary to an equal length portion of the first modified oligonucleotide.

109. An oligomeric duplex comprising:

a first oligomeric compound comprising a first modified oligonucleotide consisting of 19 to 29 linked nucleosides wherein the nucleobase sequence of the first modified oligonucleotide comprises at least 8, at least 9, at least 10, at least 11, at least 12, at least 13, at least 14, at least 15, at least 16, at least 17, at least 18, at least 19, at least 20, at least 21, at least 22, or at least 23 contiguous nucleobases of the nucleobase sequence of any of SEQ ID NOs: 1713-2024; and a second oligomeric compound comprising a second modified oligonucleotide consisting of 15 to 29 linked nucleosides wherein the nucleobase sequence of the second modified oligonucleotide comprises a complementary region of at least 8 nucleobases that is at least 90% complementary to an equal length portion of the first modified oligonucleotide.

110. An oligomeric duplex comprising:

a first oligomeric compound comprising a first modified oligonucleotide consisting of 19 to 29 linked nucleosides wherein the nucleobase sequence of the first modified oligonucleotide comprises at least 8, at least 9, at least 10, at least 11, at least 12, at least 13, at least 14, at least 15, at least 16, at least 17, at least 18, at least 19, at least 20, at least 21, at least 22, or at least 23 contiguous nucleobases of the nucleobase sequence of any of SEQ ID NOs: 1713-2024; and a second oligomeric compound comprising a second modified oligonucleotide consisting of 15 to 29 linked nucleosides wherein the nucleobase sequence of the second modified oligonucleotide comprises at least 8, at least 9, at least 10, at least 11, at least 12, at least 13, at least 14, at least 15, at least 16, at least 17, at least 18, at least 19, at least 20, or at least 21 contiguous nucleobases of the nucleobase sequence of any of SEQ ID NOs: 2025-2336, wherein the nucleobase sequence of the second modified oligonucleotide is at least 90% complementary to an equal length portion of the first modified oligonucleotide.

111. An oligomeric duplex comprising:

a first oligomeric compound comprising a first modified oligonucleotide consisting of 23 linked nucleosides wherein the nucleobase sequence of the first modified oligonucleotide consists of the nucleobase sequence of any of SEQ ID NOs: 1713-2024; and a second oligomeric compound comprising a second modified oligonucleotide consisting of 21 linked nucleosides wherein the nucleobase sequence of the second modified oligonucleotide consists of the nucleobase sequence of any of SEQ ID NOs: 2025-2336, wherein the nucleobase sequence of the second modified oligonucleotide is at least 90% complementary to an equal length portion of the first modified oligonucleotide.

112. The oligomeric duplex of any of embodiments 107-111, wherein the modified oligonucleotide of the first oligomeric compound comprises a 5'-stabilized phosphate group.

113. The oligomeric duplex of embodiment 112, wherein the 5'-stabilized phosphate group comprises a cyclopropyl phosphonate or a vinyl phosphonate.

114. The oligomeric duplex of any of embodiments 107-113, wherein the modified oligonucleotide of the first oligomeric compound comprises a glycol nucleic acid (GNA) sugar surrogate.

115. The oligomeric duplex of any of embodiments 107-114, wherein the modified oligonucleotide of the first oligomeric compound comprises a 2'-NMA sugar moiety.

116. The oligomeric duplex of any of embodiments 107-115, wherein at least one nucleoside of the second modified oligonucleotide comprises a modified sugar moiety.

117. The oligomeric duplex of embodiment 116, wherein the modified sugar moiety of the second modified oligonucleotide comprises a bicyclic sugar moiety.

118. The oligomeric duplex of embodiment 117, wherein the bicyclic sugar moiety of the second modified oligonucleotide comprises a 2'-4' bridge selected from —O—$CH_2$—; and —O—$CH(CH_3)$—.

119. The oligomeric duplex of embodiment 116, wherein the modified sugar moiety of the second modified oligonucleotide comprises a non-bicyclic modified sugar moiety.

120. The oligomeric duplex of embodiment 119, wherein the non-bicyclic modified sugar moiety of the second modified oligonucleotide is a 2'-MOE sugar moiety, a 2'-F sugar moiety, or 2'-OMe sugar moiety.

121. The oligomeric duplex of any of embodiments 107-120, wherein at least one nucleoside of the second modified oligonucleotide comprises a sugar surrogate.

122. The oligomeric duplex of any of embodiments 107-121, wherein the second modified oligonucleotide comprises at least one modified internucleoside linkage.

123. The oligomeric duplex of embodiment 122, wherein at least one modified internucleoside linkage of the second modified oligonucleotide is a phosphorothioate internucleoside linkage.

124. The oligomeric duplex of any of embodiments 107-123, wherein the second modified oligonucleotide comprises at least one phosphodiester internucleoside linkage.

125. The oligomeric duplex of any of embodiments 107-124, wherein each internucleoside linkage of the second modified oligonucleotide is independently selected from a phosphodiester or a phosphorothioate internucleoside linkage.

126. The oligomeric duplex of any of embodiments 107-125, wherein the internucleoside linkage motif of the first modified oligonucleotide is ssooooooooooooooooooss and the internucleoside linkage motif of the second modified oligonucleotide is ssooooooooooooooooss, wherein wherein each "o" represents a phosphodiester internucleoside linkage and each "s" represents a phosphorothioate internucleoside linkage.

127. The oligomeric duplex of any of embodiments 107-126, wherein the second modified oligonculeotide comprises at least one modified nucleobase.

128. The oligomeric duplex of embodiment 127, wherein the modified nucleobase of the second modified oligonucleotide is 5-methylcytosine.

129. The oligomeric duplex of any of embodiments 107-128, wherein the second modified oligonucleotide comprises a conjugate group.

130. The oligomeric duplex of embodiment 129, wherein the conjugate group comprises a conjugate linker and a conjugate moiety.

131. The oligomeric duplex of embodiment 129 or 130, wherein the conjugate group is attached to the second modified oligonucleotide at the 5'-end of the second modified oligonucleotide.

132. The oligomeric duplex of embodiment 129 or 130, wherein the conjugate group is attached to the second modified oligonucleotide at the 3'-end of the modified oligonucleotide.

133. The oligomeric duplex of any of embodiments 129-132, wherein the conjugate group comprises a C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, C12 alkenyl, C11 alkenyl, C9 alkenyl, C8 alkenyl, C7 alkenyl, C6 alkenyl, or C5 alkenyl.

134. The oligomeric duplex of any of embodiments 129-133, wherein the conjugate moiety is a 6-palmitamidohexyl conjugate moiety.

135. The oligomeric duplex of any of embodiments 129-132, wherein the conjugate group has the following structure:

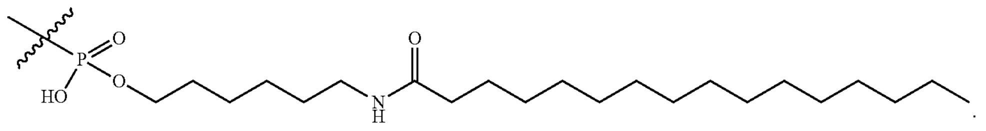

136. The oligomeric duplex of any of embodiments 129-135, wherein the conjugate group comprises a cell-targeting moiety.

137. The oligomeric duplex of embodiment 136, wherein the cell-targeting moiety has an affinity for TfR1.

138. The oligomeric duplex of embodiment 137, wherein the cell-targeting moiety comprises an anti-TfR1 antibody or fragment thereof.

139. The oligomeric duplex of embodiment 137, wherein the cell-targeting moiety comprises a protein or peptide capable of binding TfR1.

140. The oligomeric duplex of embodiment 137, wherein the cell-targeting moiety comprises an aptamer capable of binding TfR1.

141. The oligomeric duplex of any of embodiments 107-140, wherein the second modified oligonucleotide comprises a terminal group.

142. The oligomeric duplex of embodiment 141, wherein the terminal group is an abasic sugar moiety.

143. The oligomeric duplex of any of embodiments 107-142, wherein the second modified oligonucleotide consists of 10 to 25, 10 to 30, 10 to 50, 12 to 20, 12 to 25, 12 to 30, 12 to 50, 13 to 20, 13 to 25, 13 to 30, 13 to 50, 14 to 20, 14 to 25, 14 to 30, 14 to 50, 15 to 20, 15 to 25, 15 to 30, 15 to 50, 16 to 18, 16 to 20, 16 to 25, 16 to 30, 16 to 50, 17 to 20, 17 to 25, 17 to 30, 17 to 50, 18 to 20, 18 to 25, 18 to 30, 18 to 50, 19 to 20, 19 to 25, 19 to 30, 19 to 50, 20 to 25, 20 to 30, 20 to 50, 21 to 25, 21 to 30, 21 to 50, 22 to 25, 22 to 30, 22 to 50, 23 to 25, 23 to 30, or 23 to 50 linked nucleosides.

144. The oligomeric duplex of any of embodiments 107-143, wherein the modified oligonucleotide of the first oligomeric compound consists of 23 linked nucleosides and the second modified oligonucleotide consists of 21 linked nucleosides.

145. The oligomeric duplex of embodiment 144, wherein the modified oligonucleotide of the first oligomeric compound has a sugar motif (from 5' to 3') of: yfyfyfyfyfyfyfyfyfyfyyy and the second modified oligonucleotide has a sugar motif (from 5' to 3') of: fyfyfyfyfyfyfyfyfyfyf, wherein each "y" represents a 2'-OMe sugar moiety and each "f" represents a 2'-F sugar moiety.

146. An antisense agent comprising an antisense compound, wherein the antisense compound is the oligomeric compound of any of embodiments 1-79 or the modified oligonucleotide of any of embodiments 80-100.

147. An antisense agent, wherein the antisense agent is the oligomeric duplex of any of embodiments 107-145.

148. The antisense agent of embodiment 146 or 147, wherein the antisense agent is:

i. an RNase H agent capable of reducing the amount of PLN nucleic acid through the activation of RNase H;
ii. an RNAi agent capable of reducing the amount of PLN nucleic acid through the activation of RISC/Ago2;

149. The antisense agent of any of embodiments 146-148, wherein the conjugate group is a cell-targeting moiety.

150. A pharmaceutical composition comprising the oligomeric compound of any of embodiments 1-79, the modified oligonucleotide of any of embodiments 80-100, the population of any of embodiments 101-106, the oligomeric duplex of any of embodiments 107-145, or the antisense agent of any of embodiments 146-149, and a pharmaceutically acceptable diluent or carrier.

151. The pharmaceutical composition of embodiment 150, wherein the pharmaceutically acceptable diluent is water or phosphate-buffered saline.

152. The pharmaceutical composition of embodiment 151, wherein the pharmaceutical composition consists essentially of the oligomeric compound, the modified oligonucleotide, the oligomeric duplex, or the antisense agent, and water or phosphate-buffered saline.

153. A method comprising administering to a subject the oligomeric compound of any of embodiments 1-79, the modified oligonucleotide of any of embodiments 80-100, the population of any of embodiments 101-106, the oligomeric duplex of any of embodiments 107-145, the antisense agent of any of embodiments 146-149, or the pharmaceutical composition of any of embodiments 150-152.

154. A method of treating a disease associated with PLN comprising administering to a subject having a disease associated with PLN a therapeutically effective amount of the oligomeric compound of any of embodiments 1-79, the modified oligonucleotide of any of embodiments 80-100, the population of any of embodiments 101-106, the oligomeric duplex of any of embodiments 107-145, the antisense agent of any of embodiments 146-149, or the pharmaceutical composition of any of embodiments 150-152; thereby treating the disease associated with PLN.

155. The method of embodiment 154, wherein the disease associated with PLN is cardiomyopathy, heart failure, or arrhythmia.

156. The method of embodiment 155, wherein the cardiomyopathy is genetic cardiomyopathy.

157. The method of embodiment 156, wherein the genetic cardiomyopathy is associated with p.Arg14del, Arg9Cys (R9C), or Arg25Cys (R25C) genetic mutations.

158. The method of embodiment 155, wherein the cardiomyopathy is dilated cardiomyopathy (DCM).

159. The method of embodiment 157, wherein the DCM is genetic DCM.

160. The method of embodiment 159, wherein the genetic DMC is associated with TTN, LMNA, RBM20, SCN5A, MYH7, TNNT2, and TPM1 mutations.

161. The method of embodiment 158, wherein the DCM is arrhythmogenic DCM.

162. The method of embodiment 155, wherein the heart failure is heart failure with preserved ejection fraction (HFpEF), heart failure with reduced ejection fraction (HFrEF), acute heart failure, or worsening of chronic heart failure.

163. The method of embodiment 155, wherein the arrhythmia is ventricular tachycardia (Vtac) or ventricular fibrillation (Vfib).

164. The method of any of embodiments 155-163, wherein administering the oligomeric compound of any of embodiments 1-79, the modified oligonucleotide of any of embodiments 80-100, the population of any of embodiments 101-106, the oligomeric duplex of any of embodiments 107-145, the antisense agent of any of embodiments 146-149, or the pharmaceutical composition of any of embodiments 150-152 improves cardiac function, cardiovascular death, cardiac dilation, cardiac fibrosis, low voltage ECG, diastolic calcium uptake, ejection fraction (EF), left ventricular ejection fraction (LVEF), left ventricular end systolic volume (LVESV), left ventricular end diastolic volume (LVEDV), mitral valve flow profile, left ventricle (LV) strain, left ventricle (LV) strain rate, infarct size, heart failure hospitalization, 6 minute walk test (6MWT), the Kansas City Cardiomyopathy Questionnaire Score (KCCQS), heart rate, or heart rhythm in the subject.

165. A method of reducing expression of PLN in a cell comprising contacting the cell with the oligomeric compound of any of embodiments 1-79, the modified oligonucleotide of any of embodiments 80-100, the population of any of embodiments 101-106, the oligomeric duplex of any of embodiments 107-145, the antisense agent of any of embodiments 146-149, or the pharmaceutical composition of any of embodiments 150-152.

166. The method of embodiment 157, wherein the cell is a heart cell.

167. Use of the oligomeric compound of any of embodiments 1-79, the modified oligonucleotide of any of embodiments 80-100, the population of any of embodiments 101-106, the oligomeric duplex of any of embodiments 107-145, the antisense agent of any of embodiments 146-149, or the pharmaceutical composition of any of embodiments 150-152 for treating a disease associated with PLN.

168. Use of the oligomeric compound of any of embodiments 1-79, the modified oligonucleotide of any of embodiments 80-100, the population of any of embodiments 101-106, the oligomeric duplex of any of embodiments 107-145, the antisense agent of any of embodiments 146-149, or the pharmaceutical composition of any of embodiments 150-152 in the manufacture of a medicament for treating a disease associated with PLN.

169. The use of embodiment 159 or 160, wherein the disease associated with PLN is cardiomyopathy, heart failure, or arrhythmia.

170. The use of embodiment 169, wherein the cardiomyopathy is genetic cardiomyopathy.

171. The use of embodiment 170, wherein the genetic cardiomyopathy is associated with p.Arg14del, Arg9Cys (R9C), or Arg25Cys (R25C) genetic mutations.

172. The use of embodiment 169, wherein the cardiomyopathy is dilated cardiomyopathy (DCM).

173. The use of embodiment 172, wherein the DCM is genetic DCM.

174. The use of embodiment 173, wherein the genetic DMC is associated with TTN, LMNA, RBM20, SCN5A, MYH7, TNNT2, and TPM1 mutations.

175. The use of embodiment 172, wherein the DCM is arrhythmogenic DCM.

176. The use of embodiment 169, wherein the heart failure is heart failure with preserved ejection fraction (HFpEF), heart failure with reduced ejection fraction (HFrEF), acute heart failure, or worsening of chronic heart failure.

177. The use of embodiment 176, wherein the arrhythmia is ventricular tachycardia (Vtac) or ventricular fibrillation (Vfib).

Certain Oligomeric Agents and Oligomeric Compounds

Certain embodiments provide oligomeric agents targeted to a PLN nucleic acid. In certain embodiments, the PLN nucleic acid has the sequence set forth in RefSeq or GENBANK Accession No. NM_002667.4 or NC_000006.12, truncated from nucleosides 118545001 to 118565000, each of which is incorporated by reference in its entirety. In certain embodiments, the oligomeric agent is a single-stranded oligomeric compound. In certain embodiments, the oligomeric agent is oligomeric duplex.

Certain embodiments provide an oligomeric compound comprising a modified oligonucleotide consisting of 8 to 80 linked nucleosides, wherein the nucleobase sequence of the modified oligonucleotide is at least 80% complementary to an equal length portion of a PLN nucleic acid, and wherein the modified oligonucleotide has at least one modification selected from a modified sugar moiety and a modified internucleoside linkage. In certain embodiments, the PLN nucleic acid has the nucleobase sequence of SEQ ID NOs: 1 or 2. In certain embodiments, the nucleobase sequence of the modified oligonucleotide is at least 80% complementary to an equal length portion within nucleobases 3278-3293, 3281-3296, 3282-3297, 3284-3299, 3286-3301, 3287-3302, 3288-3303, 3327-3342, 3329-3344, 3332-3347, 3333-3348, 3336-3351, 3337-3352, 3338-3353, 3339-3354, 3340-3355, 3341-3356, 3343-3358, 3345-3360, 3348-3363, 3349-3364, 3350-3365, 3351-3366, 3352-3367, 3353-3368, 3354-3369, 3355-3370, 3356-3371, 3357-3372, 3358-3373, 3395-3410, 3396-3411, 3405-3420, 3406-3421, 3408-3423, 3409-3424, 3410-3425, 3412-3427, 3496-3511, 3497-3512, 3498-3513, 3499-3514, 3598-3613, 3612-3627, 3614-3629, 3615-3630, 3616-3631, 3617-3632, 3618-3633, 3619-3634, 3620-3635, 3622-3637, 3703-3718, 3704-3719, 3715-3730, 3716-3731, 3723-3738, 3724-3739, 3799-3814, 3801-3816, 3802-3817, 3803-3818, 3804-3819, 3805-3820, 3806-3821, 3807-3822, 3808-3823, 3809-3824, 3811-3826, 3814-3829, 3815-3830, 3816-3831, 3817-3832, 3821-3836, 3823-3838, 3830-3845, 3831-3846, 3848-3863, 3849-3864, 3850-3865, 3851-3866, 3861-3876, 3863-3878, 3864-3879, 3869-3884, 3871-3886, 3976-3991, 3977-3992, 3978-3993, 3980-3995, 3981-3996, 4116-4131, 4159-4174, 4204-4219, 4207-4222, 4208-4223, 4209-4224, 4210-4225, 4211-4226, 4212-4227, 4214-4229, 4221-4236, 4231-4246, 4232-4247, 4233-4248, 4234-4249, 4235-4250, 4236-4251, 4238-4253, 4252-4267, 4253-4268, 4266-4281, 4348-4363, 4349-4364, 4350-4365, 4367-4382, 4373-4388, 4374-4389, 4375-4390, 4510-4525, 4511-4526, 4513-4528, 4515-4530, 4516-4531, 4517-4532, 4518-4533, 4519-4534, 4530-4545, 4537-4552, 4539-4554, 4540-4555, 4541-4556, 4542-4557, 4543-4558, 4544-4559, 4545-4560, 4562-4577, 4614-4629, 4617-4632, 4619-4634, 4620-4635, 4621-4636, 4622-4637, 4623-4638, 4624-4639, 4638-4653, 4640-4655, 4641-4656, 4642-4657, 4643-4658, 4665-4680, 4672-4687, 4693-4708, 4694-4709, 4695-4710, 4696-4711, 4697-4712, 4750-4765, 4751-4766, 4752-4767, 4753-4768, 4774-4789, 4802-4817, 4804-4819, 4805-4820, 4806-4821, 4807-4822, 4823-4838, 4825-4840, 4826-4841, 4828-4843, 4860-4875, 4862-4877, 4869-4884, 4872-4887, 4874-4889, 4878-4893, 4881-4896, 4883-4898, 4884-4899, 4942-4957, 4943-4958, 4945-4960, 4946-4961, 4957-4972, 4958-4973, 4960-4975, 4961-4976, 4964-4979, 4965-4980, 4966-4981, 4968-4983, 4969-4984, 4971-4986, 4972-4987, 4974-4989, 4984-4999, 4985-5000, 4987-5002, 4988-5003, 5024-5039, 5127-5142, 5133-5148, 5134-5149, 5158-5173, 5159-5174, 5160-5175, 5163-5178, 5294-5309, 5341-5356, 5359-5374, 5394-5409, 5399-5414, 5400-5415, 5401-5416, 5402-5417, 5404-5419, 5411-5426, 5413-5428, 5414-5429, 5415-5430, 5416-5431, 5417-5432, 5418-5433, 5419-5434, 5421-5436, 5427-5442, 5428-5443, 5489-5504, 5494-5509, 5495-5510, 5497-5512, 5498-5513, 5498-5515, 5498-5517, 5499-5514, 5499-5515, 5499-5516, 5499-5518, 5500-5515, 5500-5516, 5500-5517, 5501-5516, 5501-5514, 5501-5517, 5502-5517, 5502-5515, 5503-5518, 5504-5519, 5505-5520, 5506-5521, 5511-5526, 5532-5547, 5533-5548, 5534-5549, 5547-5562, 5557-5572, 5558-5573, 5559-5574, 5560-5575, 5562-5577, 5563-5578, 5565-5580, 5599-5614, 5673-5688, 5674-5689, 5675-5690, 5676-5691, 5677-5692, 5678-5693, 5679-5694, 5694-5709, 5695-5710, 5696-5711, 5697-5712, 5698-5713, 5774-5789, 5827-5842, 5845-5860, 5847-5862, 5848-5863, 5850-5865, 5851-5866, 5855-5870, 5859-5874, 5924-5939, 5925-5940, 5926-5941, 5927-5942, 5929-5944, 5930-5945, 5931-5946, 5932-5947, 6008-6023, 6009-6024, 6039-6054, 6053-6068, 6054-6069, 6055-6070, 6059-6074, 6066-6081, 6069-6084, 6070-6085, 6076-6091, 6092-6107, 6098-6113, 6112-6127, 6114-6129, 6117-6132, 6118-6133, 6119-6134, 6124-6139, 6125-6140, 6126-6141, 6147-6162, 6154-6169, 6155-6170, 6156-6171, 6157-6172, 6176-6191, 6177-6192, 6185-6200, 6186-6201, 6187-6202, 6188-6203, 6202-6217, 6209-6224, 6243-6258, 6249-6264, 6267-6282, 6268-6283, 6274-6289, 6275-6290, 6291-6306, 6338-6353, 6352-6367, 6353-6368, 6354-6369, 6365-6380, 6366-6381, 6368-6383, 6369-6384, 6403-6418, 6405-6420, 6406-6421, 6407-6422, 6408-6423, 6409-6424, 6410-6425, 6411-6426, 6413-6428, 6468-6483, 6471-6486, 6502-6517, 6546-6561, 6554-6569, 6555-6570, 6556-6571, 6557-6572, 6569-6584, 6574-6589, 6575-6590, 6576-6591, 6577-6592, 6578-6593, 6579-6594, 6644-6659, 6646-6661, 6647-6662, 6664-6679, 6665-6680, 6666-6681, 6667-6682, 6676-6691, 6677-6692, 6746-6761, 6804-6819, 6806-6821, 6825-6840, 6826-6841, 6827-6842, 6828-6843, 6831-6846, 6833-6848, 6834-6849, 6875-6890, 6877-6892, 6879-6894, 6880-6895, 6881-6896, 6893-6908, 6896-6911, 6898-6913, 6899-6914, 6900-6915, 6901-6916, 6903-6918, 6904-6919, 6906-6921, 6907-6922, 6908-6923, 6920-6935, 6921-6936, 6922-6937, 6923-6938, 6927-6942, 6928-6943, 6930-6945, 6937-6952, 6939-6954, 6940-6955, 6941-6956, 6942-6957, 6943-6958, 6944-6959, 6945-6960, 6947-6962, 6965-6980, 6966-6981, 6967-6982, 6968-6983, 6972-6987, 6975-6990, 7029-7044, 7042-7057, 7047-7062, 7050-7065, 7073-7088, 7082-7097, 7083-7098, 7102-7117, 7106-7121, 7107-7122, 7108-7123, 7120-7135, 7122-7137, 7123-7138, 7124-7139, 7125-7140, 7126-7141, 7128-7143, 7129-7144, 7130-7145, 7131-7146, 7279-7294, 7280-7295, 7282-7297, 7283-7298, 7284-7299, 7285-7300, 7286-7301, 7287-7302, 7320-7335, 7341-7356, 7342-7357, 7344-7359, 7353-7368, 7354-7369, 7356-7371, 7357-7372, 7358-7373, 7359-7374, 7360-7375, 7361-7376, 7362-7377, 7377-7392, 7378-7393, 7392-7407, 7393-7408, 7411-7426, 7425-7440, 7436-7451, 7457-7472, 7458-7473, 7459-7474, 7460-7475, 7461-7476, 7463-7478, 7464-7479, 7470-7485, 7516-7531, 7518-7533, 7519-7534, 7520-7535, 7521-7536, 7522-7537, 7546-7561, 7548-7563, 7553-7568, 7554-7569, 7555-7570, 7556-7571, 7558-7573, 7560-7575, 7561-7576, 7562-7577, 7563-7578, 7564-7579, 7565-7580, 7566-7581, 7568-7583, 7587-7602, 7588-7603, 7589-7604, 7595-7610, 7638-7653, 7679-7694, 7726-7741, 7779-7794, 7797-7812, 7799-7814, 7806-7821, 7857-7872, 7859-7874, 7860-7875, 7861-7876, 7862-7877, 7863-7878, 7864-7879, 7865-7880, 7867-7882, 7876-7891, 7878-7893, 7888-7903, 7889-7904, 7893-7908, 7908-7923, 7929-7944, 7965-7980, 7967-7982, 7968-7983, 8047-8062, 8058-8073, 8061-8076, 8089-8104, 8090-8105, 8163-8178, 8182-8197, 8194-8209, 8195-8210, 8196-8211, 8197-8212, 8284-8299, 8285-8300, 8286-8301, 8287-8302, 8288-8303, 8326-8341, 8336-8351, 8352-8367, 8353-8368, 8368-8383, 8393-8408, 8412-8427, 8413-8428, 8415-8430, 8418-8433, 8427-8442, 8447-8462, 8493-8508, 8494-8509, 8495-8510, 8496-8511, 8498-8513, 8542-8557, 8573-8588, 8621-8636, 8627-8642, 8628-8643, 8638-8653, 8639-8654, 8641-8656, 8653-8668, 8655-8670, 8703-8718, 8708-8723, 8732-8747, 8733-8748, 8739-8754, 8774-8789, 8776-8791, 8777-8792, 8818-8833, 8823-8838, 8824-8839, 8826-8841, 8827-8842, 8850-8865, 8855-8870, 8942-8957, 8943-8958, 8944-8959, 8955-8970, 8961-8976, 8962-8977, 8963-8978, 8964-8979, 9377-9392, 9443-9458, 9474-9489, 9523-9538, 9524-9539, 9525-9540, 9526-9541, 9528-9543, 9536-9551, 9537-9552, 9538-9553, 9540-9555, 9541-9556, 9545-9560, 9549-9564, 9550-9565, 9587-9602, 9630-9645, 9641-9656, 9642-9657, 9646-9661, 9647-9662, 9648-9663, 9649-9664, 9651-9666, 9660-9675, 9668-9683, 9669-9684, 9672-9687, 9697-9712, 9702-9717, 9703-9718, 9706-9721, 9707-9722, 9708-9723, 9709-9724, 9710-9725, 9711-9726, 9720-9735, 9727-9742, 9752-9767, 9756-9771, 9788-9803, 9934-9949, 9936-9951, 9937-9952, 9938-9953, 9939-9954, 9940-9955, 10019-10034, 10054-10069, 10062-10077, 10081-10096, 10106-10121, 10117-10132, 10443-10458, 10444-10459, 10445-10460, 10480-10495, 10481-10496, 10486-10501, 10489-10504, 10490-10505, 10491-10506, 10532-10547, 10623-10638, 10638-10653, 10645-10660, 10718-10733, 10719-10734, 10720-10735, 10721-10736, 10722-10737, 10723-10738, 10724-10739, 10747-10762, 10770-10785, 11066-11081, 11068-11083, 11104-11119, 11111-11126, 11112-11127, 11115-11130, 11116-11131, 11118-11133, 11130-11145, 11144-11159, 11224-11239, 11225-11240, 11237-11252, 11258-11273, 11259-11274, 11302-11317, 11353-11368, 11356-11371, 11368-11383, 11369-11384, 11409-11424, 11410-11425, 11411-11426, 11412-11427, 11413-11428, 11414-11429, 11415-11430, 11417-11432, 11457-11472, 11458-11473, 11467-11482, 11474-11489, 11475-11490, 11509-11524, 11510-11525, 11511-11526, 11524-11539, 11525-11540, 11526-11541, 11527-11542, 11529-11544, 11530-11545, 11622-11637, 11631-11646, 11632-11647, 11633-11648, 11634-11649, 11635-11650, 11636-11651, 11639-11654, 11670-11685, 11678-11693, 11679-11694, 11680-11695, 11681-11696, 11682-11697, 11684-11699, 11685-11700, 11726-11741, 11727-11742, 11740-11755, 11741-11756, 11742-11757, 11743-11758, 11799-11814, 11832-11847, 11833-11848, 11854-11869, 11855-11870, 11856-11871, 11857-11872, 11858-11873, 11859-11874, 11900-11915, 11931-11946, 11956-11971, 11988-12003, 11989-12004, 11990-12005, 11991-12006, 11992-12007, 11993-12008, 11994-12009, 11995-12010, 11997-12012, 11998-12013, 11999-12014, 12000-12015, 12015-12030, 12016-12031, 12017-12032, 12027-12042, 12032-12047, 12040-12055, 12041-12056, 12042-12057, 12076-12091, 12080-12095, 12081-12096, 12082-12097, 12084-12099, 12085-12100, 12086-12101, 12087-12102, 12088-12103, 12089-12104, 12090-12105, 12092-12107, 12194-12209, 12195-12210, 12238-12253, 12239-12254, 12241-12256, 12242-12257, 12243-12258, 12246-12261, 12282-12297, 12283-12298, 12285-12300, 12286-12301, 12287-12302, 12288-12303, 12307-12322, 12308-12323, 12310-12325, 12312-12327, 12315-12330, 12348-12363, 12355-12370, 12356-12371, 12357-12372, 12368-12383, 12388-12403, 12389-12404, 12390-12405, 12391-12406, 12392-12407, 12470-12485, 12471-12486, 12472-12487, 12473-12488, 12474-12489, 12498-12513, 12529-12544, 12530-12545, 12546-12561, 12548-12563, 12550-12565, 12551-12566, 12585-12600, 12721-12736, 12722-12737, 12723-12738, 12724-12739, 12727-12742, 12732-12747, 12733-12748, 12734-12749, 12735-12750, 12760-12775, 12812-12827, 12813-12828, 12817-12832, 12818-12833, 12912-12927, 12915-12930, 12929-12944, 12943-12958, 12946-12961, 13243-13258, 13327-13342, 13409-13424, 13431-13446, 13438-13453, 13460-13475, 13461-13476, 13484-13499, 13485-13500, 13486-13501, 13489-13504, 13490-13505, 13491-13506, 13492-13507, 13493-13508, 13525-13540, 13528-13543, 13529-13544, 13530-13545, 13717-13732, 13736-13751, 13770-13785, 13776-13791, 13777-13792, 13786-13801, 13814-13829, 13816-13831, 13818-13833, 13819-13834, 13820-13835, 13821-13836, 13822-13837, 13823-13838, 13835-13850, 13836-13851, 13837-13852, 13838-13853, 13839-13854, 13843-13858, 13870-13885, 13872-13887, 13875-13890, 13876-13891, 13877-13892, 13878-13893, 13879-13894, 13880-13895, 13881-13896, 13882-13897, 13883-13898, 13885-13900, 13904-13919, 13905-13920, 13906-13921, 13907-13922, 13908-13923, 13910-13925, 13912-13927, 13918-13933, 13924-13939, 13926-13941, 13927-13942, 13930-13945, 13934-13949, 13935-13950, 13936-13951, 13937-13952, 13938-13953, 13939-13954, 13940-13955, 13941-13956, 13942-13957, 13943-13958, 13944-13959, 13945-13960, 13946-13961, 13952-13967, 13953-13968, 13954-13969, 13955-13970, 13956-13971, 13957-13972, 13958-13973, 13959-13974, 13960-13975, 13961-13976, 13962-13977, 13963-13978, 13964-13979, 13965-13980, 13966-13981, 13967-13982, 13968-13983, 13969-13984, 13970-13985, 13973-13988, 13976-13991, 14000-14015, 14003-14018, 14028-14043, 14030-14045, 14032-14047, 14035-14050, 14036-14051, 14038-14053, 14039-14054, 14040-14055, 14041-14056, 14045-14060, 14047-14062, 14048-14063, 14049-14064, 14050-14065, 14051-14066, 14053-14068, 14054-14069, 14055-14070, 14056-14071, 14059-14074, 14060-14075, 14061-14076, 14062-14077, 14063-14078, 14064-14079, 14065-14080, 14066-14081, 14078-14093, 14081-14096, 14082-14097, 14084-14099, 14085-14100, 14086-14101, 14087-14102, 14088-14103, 14089-14104, 14090-14105, 14091-14106, 14092-14107, 14093-14108, 14095-14110, 14096-14111, 14097-14112, 14098-14113, 14099-14114, 14100-14115, 14102-14117, 14105-14120, 14110-14125, 14111-14126, 14112-14127, 14113-14128, 14115-14130, 14117-14132, 14119-14134, 14130-14145, 14163-14178, 14165-14180, 14166-14181, 14167-14182, 14169-14184, 14170-14185, 14174-14189, 14180-14195, 14181-14196, 14203-14218, 14207-14222, 14209-14224, 14212-14227, 14217-14232, 14220-14235, 14222-14237, 14223-14238, 14224-14239, 14225-14240, 14232-14247, 14233-14248, 14235-14250, 14242-14257, 14244-14259, 14247-14262, 14248-14263, 14249-14264, 14250-14265, 14251-14266, 14252-14267, 14253-14268, 14254-14269, 14255-14270, 14256-14271, 14257-14272, 14316-14331, 14317-14332, 14318-14333, 14319-14334, 14321-14336, 14324-14339, 14327-14342, 14337-14352, 14338-14353, 14339-14354, 14340-14355, 14341-14356, 14342-14357, 14343-14358, 14344-14359, 14345-14360, 14346-14361, 14347-14362, 14398-14413, 14400-14415, 14401-14416, 14403-14418, 14404-14419, 14405-14420, 14406-14421, 14408-14423, 14409-14424, 14410-14425, 14412-14427, 14443-14458, 14479-14494, 14480-14495, 14482-14497, 14504-14519, 14507-14522, 14508-14523, 14509-14524, 14510-14525, 14511-14526, 14512-14527, 14513-14528, 14514-14529, 14515-14530, 14515-14532, 14515-14534, 14516-14531, 14516-14532, 14516-14533, 14517-14532, 14517-14533, 14518-14531, 14519-14534, 14520-14535, 14522-14537, 14534-14549, 14535-14550, 14553-14568, 14569-14584, 14570-14585, 14571-14586, 14573-14588, 14601-14616, 14602-14617, 14603-14618, 14605-14620, 14606-14621, 14607-14622, 14608-14623, 14609-14624, 14610-14625, 14611-14626, 14612-14627, 14613-14628, 14614-14629, 14615-14630, 14616-14631, 14655-14670, 14656-14671, 14658-14673, 14659-14674, 14681-14696, 14683-14698, 14684-14699, 14684-14701, 14684-14703, 14685-14700, 14685-14701, 14685-14702, 14686-14701, 14686-14702, 14687-14702, 14687-14700, 14688-14703, 14689-14704, 14691-14706, 14692-14707, 14696-14711, 14703-14718, 14704-14719, 14705-14720, 14706-14721, 14707-14722, 14708-14723, 14709-14724, 14710-14725, 14711-14726, 14712-14727, 14713-14728, 14714-14729, 14759-14774, 14760-14775, 14761-14776, 14762-14777, 14763-14778, 14764-14779, 14765-14780, 14766-14781, 14767-14782, 14768-14783, 14769-14784, 14770-14785, 14771-14786, 14772-14787, 14773-14788, 14774-14789, 14775-14790, 14776-14791, 14779-14794, 14787-14802, 14792-14807, 14793-14808, 14794-14809, 14797-14812, 14798-14813, 14800-14815, 14818-14833, 14822-14837, 14823-14838, 14824-14839, 14825-14840, 14826-14841, 14827-14842, 14828-14843, 14829-14844, 14830-14845, 14831-14846, 14832-14847, 14833-14848, 14834-14849, 14835-14850, 14841-14856, 14842-14857, 14843-14858, 14844-14859, 14845-14860, 14846-14861, 14847-14862, 14848-14863, 14849-14864, 14850-14865, 14851-14866, 14852-14867, 14853-14868, 14855-14870, 14856-14871, 14857-14872, 14858-14873, 14859-14874, 14861-14876, 14862-14877, 14863-14878, 14864-14879, 14866-14881, 14877-14892, 14878-14893, 14880-14895, 14881-14896, 14889-14904, 14898-14913, 14899-14914, 14901-14916, 14903-14918, 14904-14919, 14905-14920, 14906-14921, 14913-14928, 14915-14930, 14916-14931, 14917-14932, 14918-14933, 14919-14934, 14921-14936, 14922-14937, 14923-14938, 14924-14939, 14925-14940, 14926-14941, 14927-14942, 14928-14943, 14929-14944, 14930-14945, 14931-14946, 14932-14947, 14933-14948, 14934-14949, 14935-14950, 14936-14951, 14937-14952, 14938-14953, 14938-14955, 14938-14957, 14939-14954, 14939-14955, 14939-14956, 14939-14958, 14940-14955, 14940-14956, 14940-14957, 14940-14959, 14941-14956, 14941-14954, 14941-14957, 14941-14958, 14941-14960, 14942-14957, 14942-14955, 14942-14958, 14942-14959, 14942-14961, 14943-14958, 14943-14956, 14943-14959, 14943-14960, 14943-14962, 14944-14959, 14944-14957, 14944-14960, 14944-14961, 14945-14960, 14945-14958, 14945-14961, 14946-14961, 14946-14959, 14948-14963, 14956-14971, 14957-14972, 14958-14973, 14959-14974, 14960-14975, 14961-14976, 14962-14977, 14963-14978, 14964-14979, 14965-14980, 14966-14981, 14968-14983, 14969-14984, 14970-14985, 14987-15002, 14992-15007, 14993-15008, 14994-15009, 14995-15010, 14996-15011, 15003-15018, 15005-15020, 15006-15021, 15007-15022, 15008-15023, 15009-15024, 15010-15025, 15011-15026, 15012-15027, 15013-15028, 15014-15029, 15015-15030, 15016-15031, 15017-15032, 15019-15034, 15142-15157, 15143-15158, 15150-15165, 15151-15166, 15152-15167, 15153-15168, 15154-15169, 15155-15170, 15156-15171, 15157-15172, 15158-15173, 15159-15174, 15160-15175, 15161-15176, 15162-15177, 15163-15178, 15164-15179, 15182-15197, 15184-15199, 15185-15200, 15186-15201, 15195-15210, 15197-15212, 15198-15213, 15199-15214, 15200-15215, 15201-15216, 15202-15217, 15203-15218, 15204-15219, 15205-15220, 15206-15221, 15207-15222, 15208-15223, 15209-15224, 15210-15225, 15211-15226, 15214-15229, 15215-15230, 15216-15231, 15217-15232, 15218-15233, 15219-15234, 15220-15235, 15221-15236, 15222-15237, 15222-15239, 15222-15241, 15223-15238, 15223-15239, 15223-15240, 15224-15239, 15224-15240, 15225-15240, 15225-15238, 15227-15242, 15228-15243, 15229-15244, 15230-15245, 15231-15246, 15232-15247, 15233-15248, 15234-15249, 15235-15250, 15236-15251, 15237-15252, 15238-15253, 15239-15254, 15247-15262, 15248-15263, 15249-15264, 15250-15265, 15251-15266, 15252-15267, 15253-15268, 15254-15269, 15255-15270, 15256-15271, 15257-15272, 15258-15273, 15259-15274, 15260-15275, 15261-15276, 15293-15308, 15299-15314, 15301-15316, 15302-15317, 15303-15318, 15304-15319, 15305-15320, 15320-15335, 15321-15336, 15323-15338, 15411-15426, 15414-15429, 15415-15430, 15416-15431, 15417-15432, 15496-15511, 15501-15516, 15504-15519, 15505-15520, 15506-15521, 15507-15522, 15508-15523, 15509-15524, 15510-15525, 15511-15526, 15512-15527, 15513-15528, 15515-15530, 15556-15571, 15558-15573, 15559-15574, 15560-15575, 15562-15577, 15569-15584, 15571-15586, 15574-15589, 15593-15608, 15594-15609, 15595-15610, 15596-15611, 15598-15613, 15599-15614, 15600-15615, 15601-15616, 15602-15617, 15603-15618, 15604-15619, 15605-15620, 15627-15642, 15629-15644, 15630-15645, 15631-15646, 15632-15647, 15633-15648, 15635-15650, 15636-15651, 15639-15654, 15640-15655, 15641-15656, 15642-15657, 15658-15673, 15659-15674, 15660-15675, 15661-15676, 15665-15680, 15666-15681, 15667-15682, 15668-15683, 15671-15686, 15673-15688, 15674-15689, 15675-15690, 15681-15696, 15682-15697, 15683-15698, 15684-15699, 15685-15700, 15686-15701, 15687-15702, 15740-15755, 15741-15756, 15753-15768, 15757-15772, 15758-15773, 15761-15776, 15762-15777, 15763-15778, 15765-15780, 15788-15803, 15812-15827, 15813-15828, 15814-15829, 15815-15830, 15816-15831, 15826-15841, 15827-15842, 15833-15848, 15858-15873, 15861-15876, 15863-15878, 15864-15879, 15865-15880, 15866-15881, 15867-15882, 15868-15883, 15869-15884, 15870-15885, 15871-15886, 15872-15887, 15873-15888, 15874-15889, 15875-15890, 15876-15891, 15877-15892, 15878-15893, 15882-15897, 15883-15898, 15910-15925, 15911-15926, 15912-15927, 15913-15928, 15914-15929, 15943-15958, 15947-15962, 15949-15964, 15950-15965, 15951-15966, 15955-15970, 15973-15988, 15974-15989, 15979-15994, 15980-15995, 16000-16015, 16008-16023, 16010-16025, 16026-16041, 16027-16042, 16030-16045, 16032-16047, 16034-16049, 16036-16051, 16037-16052, 16038-16053, 16039-16054, 16056-16071, 16057-16072, 16080-16095, 16117-16132, 16118-16133, 16216-16231, 16248-16263, 16265-16280, 16266-16281, 16268-16283, 16269-16284, 16273-16288, 16300-16315, 16305-16320, 16306-16321, 16327-16342, 16329-16344, 16422-16437, 16427-16442, 16428-16443, 16550-16565, 16557-16572, 16564-16579, 16569-16584, 16582-16597, 16592-16607, 16617-16632, or 16676-16691 of SEQ ID NO: 2.

In certain embodiments, the nucleobase sequence of the modified oligonucleotide is at least 80% complementary to an equal length portion within nucleobases 3341-3368, 4516-4533, 5498-5517, 14337-14357, 14569-14588, 14607-14631, 14683-14703, 14828-14848, 14939-14958, 15222-15243, or 15251-15273 of SEQ ID NO: 2. In certain embodiments, the nucleobase sequence of the modified oligonucleotide is at least 80% complementary to an equal length portion within nucleobases 5499-5514, 5500-5515, 5501-5516, 14686-14701, 14941-14956, 14942-14957, or 15224-15239 of SEQ ID NO: 2. In certain embodiments, the nucleobase sequence of the modified oligonucleotide is at least 85%, at least 90%, at least 95%, or 100% complementary to an equal length portion of the PLN nucleic acid.

Certain embodiments provide an oligomeric compound comprising a modified oligonucleotide consisting of 8 to 80 linked nucleosides, wherein the nucleobase sequence of the modified oligonucleotide comprises at least 8, at least 9, at least 10, at least 11, at least 12, at least 13, at least 14, at least 15, or at least 16 contiguous nucleobases of any of the nucleobase sequences of SEQ ID NOs: 15-1712.

Certain embodiments provide an oligomeric compound comprising a modified oligonucleotide consisting of 16 to 80 linked nucleosides, wherein the nucleobase sequence of the modified oligonucleotide comprises the nucleobase sequence of any of nucleobase sequences of SEQ ID NOs: 15-1712.

Certain embodiments provide an oligomeric compound comprising a modified oligonucleotide consisting of 16 linked nucleosides, wherein the modified oligonucleotide has a nucleobase sequence consisting of the nucleobase sequence of any of the nucleobase sequences of SEQ ID NOs: 15-1712.

Certain embodiments provide an oligomeric compound comprising a modified oligonucleotide consisting of 16 to 80 linked nucleosides, wherein the nucleobase sequence of the modified oligonucleotide comprises at least 8, at least 9, at least 10, at least 11, at least 12, at least 13, at least 14, at least 15, or at least 16 contiguous nucleobases of any of the nucleobase sequences of SEQ ID NOs: 45, 120, 185, 609, 675, 737, or 752.

Certain embodiments provide an oligomeric compound comprising a modified oligonucleotide consisting of 16 to 80 linked nucleosides, wherein the nucleobase sequence of the modified oligonucleotide comprises the nucleobase sequence of any of the nucleobase sequences of SEQ ID NOs: 45, 120, 185, 609, 675, 737, or 752.

Certain embodiments provide an oligomeric compound comprising a modified oligonucleotide consisting of 16 linked nucleosides, wherein the modified oligonucleotide has a nucleobase sequence consisting of the nucleobase sequence of any of the nucleobase sequences of SEQ ID NOs: 45, 120, 185, 609, 675, 737, or 752.

In any of the oligomeric compounds provided herein, the nucleobase sequence of the modified oligonucleotide can be at least 85%, at least 90%, at least 95%, or 100% complementary to an equal length portion of a PLN nucleic acid, wherein the PLN nucleic acid has the nucleobase sequence of SEQ ID NOs: 1 or 2.

In any of the oligomeric compounds provided herein, the modified oligonucleotide can consist of 10 to 25, 10 to 30, 10 to 50, 12 to 20, 12 to 25, 12 to 30, 12 to 50, 13 to 20, 13 to 25, 13 to 30, 13 to 50, 14 to 20, 14 to 25, 14 to 30, 14 to 50, 15 to 20, 15 to 25, 15 to 30, 15 to 50, 16 to 18, 16 to 20, 16 to 25, 16 to 30, 16 to 50, 17 to 20, 17 to 25, 17 to 30, 17 to 50, 18 to 20, 18 to 25, 18 to 30, 18 to 50, 19 to 20, 19 to 25, 19 to 30, 19 to 50, 20 to 25, 20 to 30, 20 to 50, 21 to 25, 21 to 30, 21 to 50, 22 to 25, 22 to 30, 22 to 50, 23 to 25, 23 to 30, or 23 to 50 linked nucleosides.

In any of the oligomeric compounds provided herein, at least one nucleoside of the modified oligonucleotide can comprise a modified sugar moiety. In certain embodiments, the modified sugar moiety comprises a bicyclic sugar moiety, such as a 2'-4' bridge selected from —O—CH2-; and —O—CH(CH3)-. In certain embodiments, the modified sugar moiety comprises a non-bicyclic modified sugar moiety, such as a 2'-MOE sugar moiety or 2'-OMe sugar moiety.

In any of the oligomeric compounds provided herein, at least one nucleoside of the modified oligonucleotide compound can comprise a sugar surrogate.

In any of the oligomeric compounds provided herein, at least one internucleoside linkage of the modified oligonucleotide can comprise a modified internucleoside linkage, such as a phosphorothioate internucleoside linkage. In certain embodiments, each internucleoside linkage of the modified oligonucleotide can be a modified internucleoside linkage or each internucleoside linkage of the modified oligonucleotide can be a phosphorothioate internucleoside linkage.

In certain embodiments, at least one internucleoside linkage of the modified oligonucleotide can be a phosphodiester internucleoside linkage. In certain embodiments, each internucleoside linkage of the modified oligonucleotide can be independently selected from a phosphodiester or a phosphorothioate internucleoside linkage. In certain embodiments, at least 2, at least 3, at least 4, at least 5, or at least 6 internucleoside linkages of the modified oligonucleotide can be phosphodiester internucleoside linkages. In certain embodiments, at least 10, at least 11, at least 12, at least 13, at least 14, at least 15, at least 16, at least 17, or at least 18 internucleoside linkages of the modified oligonucleotide can be phosphorothioate internucleoside linkages.

In any of the oligomeric compounds provided herein, at least one nucleobase of the modified oligonucleotide can be a modified nucleobase, such as 5-methylcytosine. In certain embodiments, each cytosine is 5-methylcytosine.

In any of the oligomeric compounds provided herein, the modified oligonucleotide can comprise a deoxy region consisting of 5-12 contiguous 2'-deoxynucleosides. In certain embodiments, each nucleoside of the deoxy region is a 2'-β-D-deoxynucleoside. In certain embodiments, the deoxy region consists of 7, 8, 9, 10, or 7-10 linked nucleosides. In certain embodiments, each nucleoside immediately adjacent to the deoxy region comprises a modified sugar moiety. In certain embodiments, the deoxy region is flanked on the 5'-side by a 5'-region consisting of 1-6 linked 5'-region nucleosides and on the 3'-side by a 3'-region consisting of 1-6 linked 3'-region nucleosides; wherein the 3'-most nucleoside of the 5'-region comprises a modified sugar moiety; and the 5'-most nucleoside of the 3'-region comprises a modified sugar moiety. In certain embodiments, each nucleoside of the 3'-region comprises a modified sugar moiety. In certain embodiments, each nucleoside of the 5'-region comprises a modified sugar moiety.

In certain embodiments, a compound comprises or consists of a modified oligonucleotide consisting of 16 to 80 linked nucleobases and having a nucleobase sequence comprising the nucleobase sequence recited in any one of SEQ ID NOs: 185, 609, or 752, wherein the modified oligonucleotide has:

a gap segment consisting of ten linked 2'-deoxynucleosides;

a 5' wing segment consisting of three linked nucleosides; and a 3' wing segment consisting of three linked nucleosides;

wherein the gap segment is positioned between the 5' wing segment and the 3' wing segment; wherein each nucleoside of each wing segment comprises a cEt nucleoside; wherein each internucleoside linkage is a phosphorothioate linkage; and wherein each cytosine is a 5-methylcytosine. In certain embodiments, the modified oligonucleotide consists of 16 to 30 linked nucleosides. In certain embodiments, the modified oligonucleotide consists of 16 linked nucleosides.

In certain embodiments, an oligomeric compound comprises a modified oligonucleotide according to the following chemical notation: ${}^{m}C_{ks}{}^{m}C_{ks}A_{ks}T_{ds}A_{ds}{}^{m}C_{ds}T_{ds}T_{ds}G_{ds}A_{ds}T_{ds}T_{ds}{}^{m}C_{ds}T_{ks}{}^{m}C_{ks}A_{k}$ (SEQ ID NO: 185), wherein:

A=an adenine nucleobase,
${}^{m}C$=a 5-methyl cytosine nucleobase,
G=a guanine nucleobase,
T=a thymine nucleobase,
k=a cEt modified sugar moiety,
d=a 2'-β-D-deoxyribosyl sugar moiety, and
s=a phosphorothioate internucleoside linkage.

In certain embodiments, an oligomeric compound comprises a modified oligonucleotide according to the following chemical notation: $G_{ks}T_{ks}A_{ks}G_{ds}T_{ds}T_{ds}A_{ds}A_{ds}G_{ds}A_{ds}T_{ds}T_{ds}T_{ds}T_{ks}G_{ks}{}^{m}C_{k}$ (SEQ ID NO: 752), wherein:

A=an adenine nucleobase,
${}^{m}C$=a 5-methyl cytosine nucleobase,
G=a guanine nucleobase,
T=a thymine nucleobase,
k=a cEt modified sugar moiety,
d=a 2'-β-D-deoxyribosyl sugar moiety, and
s=a phosphorothioate internucleoside linkage.

In certain embodiments, an oligomeric compound comprises a modified oligonucleotide according to the following chemical notation: $A_{ks}{}^{m}C_{ks}A_{ks}{}^{m}C_{ds}G_{ds}A_{ds}G_{ds}T_{ds}A_{ds}T_{ds}A_{ds}T_{ds}T_{ds}A_{ks}G_{ks}G_{k}$ (SEQ ID NO: 609), wherein:

A=an adenine nucleobase,
${}^{m}C$=a 5-methyl cytosine nucleobase,
G=a guanine nucleobase,
T=a thymine nucleobase,
k=a cEt modified sugar moiety,
d=a 2'-β-D-deoxyribosyl sugar moiety, and
s=a phosphorothioate internucleoside linkage.

In certain embodiments, an oligomeric compound comprises a modified oligonucleotide according to the following chemical notation: $A_{ks}A_{ks}G_{ds}A_{ds}T_{ds}A_{ds}T_{ds}A_{ds}G_{ds}T_{ds}A_{ds}T_{ks}G_{es}G_{ks}T_{es}A_{k}$ (SEQ ID NO: 45), wherein:

A=an adenine nucleobase,
G=a guanine nucleobase,
T=a thymine nucleobase,
e=a 2'-MOE sugar moiety,
k=a cEt modified sugar moiety
d=a 2'-β-D-deoxyribosyl sugar moiety, and
s=a phosphorothioate internucleoside linkage.

In certain embodiments, an oligomeric compound comprises a modified oligonucleotide according to the following chemical notation: $A_{ks}{}^{m}C_{ks}G_{ds}A_{ds}G_{ds}T_{ds}A_{ds}T_{ds}A_{ds}T_{ds}T_{ds}A_{ks}G_{es}G_{ks}A_{es}A_{k}$ (SEQ ID NO: 737), wherein:

A=an adenine nucleobase,
${}^{m}C$=a 5-methyl cytosine nucleobase,

G=a guanine nucleobase,
T=a thymine nucleobase,
e=a 2'-MOE sugar moiety,
k=a cEt modified sugar moiety
d=a 2'-β-D-deoxyribosyl sugar moiety, and
s=a phosphorothioate internucleoside linkage.

In certain embodiments, an oligomeric compound comprises a modified oligonucleotide according to the following chemical notation: $A_{ks}A_{ks}A_{ds}G_{ds}A_{ds}T_{ds}A_{ds}T_{ds}A_{ds}G_{ds}T_{ds}A_{ks}T_{es}G_{ks}G_{es}T_{k}$ (SEQ ID NO: 120), wherein:
A=an adenine nucleobase,
G=a guanine nucleobase,
T=a thymine nucleobase,
e=a 2'-MOE sugar moiety,
k=a cEt modified sugar moiety
d=a 2'-β-D-deoxyribosyl sugar moiety, and
s=a phosphorothioate internucleoside linkage.

In certain embodiments, an oligomeric compound comprises a modified oligonucleotide according to the following chemical notation: $^{m}C_{ks}A_{ks}{}^{m}C_{ks}G_{ds}A_{ds}G_{ds}T_{ds}A_{ds}T_{ds}A_{ds}T_{ds}T_{ds}A_{ks}G_{ks}G_{ks}A_{e}$ (SEQ ID NO: 675), wherein:
A=an adenine nucleobase,
$^{m}$C=a 5-methyl cytosine nucleobase,
G=a guanine nucleobase,
T=a thymine nucleobase,
e=a 2'-MOE sugar moiety,
k=a cEt modified sugar moiety
d=a 2'-β-D-deoxyribosyl sugar moiety, and
s=a phosphorothioate internucleoside linkage.

In certain embodiments, an oligomeric compound comprises a conjugate group. In certain embodiments, the conjugate group comprises a conjugate linker and a conjugate moiety. In certain embodiments, the conjugate linker consists of a single bond, the conjugate linker is cleavable, the conjugate linker comprises 1-3 linker-nucleosides, the conjugate linker does not comprise any linker nucleosides, the conjugate group is attached to the modified oligonucleotide at the 5'-end of the modified oligonucleotide, or the conjugate group is attached to the modified oligonucleotide at the 3'-end of the modified oligonucleotide.

In certain embodiments, the conjugate group comprises a cell-targeting moiety having an affinity for transferrin receptor (TfR), also known as TfR1 and CD71. In certain embodiments, the conjugate group comprises an anti-TfR1 antibody or fragment thereof. In certain embodiments, the conjugate group comprises a protein or peptide capable of binding TfR1. In certain embodiments, the conjugate group comprises an aptamer capable of binding TfR1. In certain embodiments, conjugate groups may be selected from any of a C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, C12 alkenyl, C11 alkenyl, C9 alkenyl, C8 alkenyl, C7 alkenyl, C6 alkenyl, or C5 alkenyl. In certain embodiments, conjugate groups may be selected from any of C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, and C5 alkyl, where the alkyl chain has one or more unsaturated bonds.

In certain embodiments, the conjugate group has the following structure:

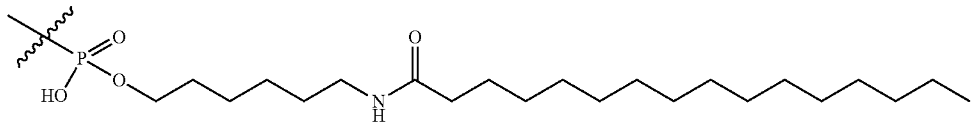

In certain embodiments, the conjugate group is a 6-palmitamidohexyl phosphate. In certain embodiments, an oligomeric compound comprises a 6-palmitamidohexyl phosphate conjugate group attached to the 5'-terminal OH of a modified oligonucleotide.

In certain embodiments, an oligomeric compound comprises a modified oligonucleotide according to the following chemical notation: $[C16\text{-}HA]_{o}A_{ks}A_{ks}G_{ds}A_{ds}T_{ds}A_{ds}T_{ds}A_{ds}G_{ds}T_{ds}A_{ds}T_{ks}G_{es}G_{ks}T_{es}A_{k}$ (SEQ ID NO: 45), wherein:
A=an adenine nucleobase,
G=a guanine nucleobase,
T=a thymine nucleobase,
e=a 2'-MOE sugar moiety,
k=a cEt modified sugar moiety
d=a 2'-β-D-deoxyribosyl sugar moiety,
o=a phosphodiester internucleoside linkage,
s=a phosphorothioate internucleoside linkage, and

[C16 - HA] =

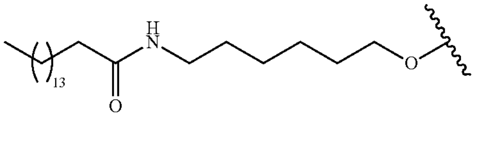

In certain embodiments, an oligomeric compound comprises a modified oligonucleotide according to the following chemical notation: $[C16\text{-}HA]_{o}A_{ks}{}^{m}C_{ks}A_{ks}{}^{m}C_{ds}G_{ds}A_{ds}G_{ds}T_{ds}A_{ds}T_{ds}A_{ds}T_{ds}T_{ds}A_{ks}G_{ks}G_{k}$ (SEQ ID NO: 609), wherein:
A=an adenine nucleobase,
$^{m}$C=a 5-methyl cytosine nucleobase,
G=a guanine nucleobase,
T=a thymine nucleobase,
k=a cEt modified sugar moiety
d=a 2'-β-D-deoxyribosyl sugar moiety,
o=a phosphodiester internucleoside linkage,
s=a phosphorothioate internucleoside linkage, and

[C16 - HA] =

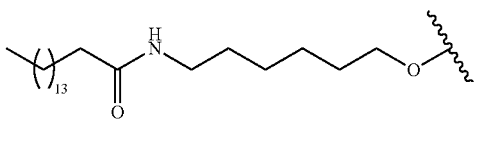

In certain embodiments, an oligomeric compound comprises a modified oligonucleotide according to the following chemical notation: $[C16\text{-}HA]_{o}G_{ks}T_{ks}A_{ks}G_{ds}T_{ds}T_{ds}A_{ds}A_{ds}G_{ds}A_{ds}T_{ds}T_{ds}T_{ds}T_{ks}G_{ks}{}^{m}C_{k}$ (SEQ ID NO: 752), wherein:
A=an adenine nucleobase,
$^{m}$C=a 5-methyl cytosine nucleobase, G=a guanine nucleobase,
T=a thymine nucleobase,
k=a cEt modified sugar moiety
d=a 2'-β-D-deoxyribosyl sugar moiety,
o=a phosphodiester internucleoside linkage,
s=a phosphorothioate internucleoside linkage, and

[C16 - HA] =

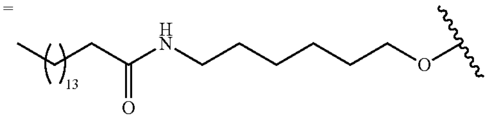

In certain embodiments, an oligomeric compound comprises a modified oligonucleotide according to the following chemical notation: $[C16\text{-}HA]_{o}A_{ks}A_{ks}A_{ds}G_{ds}A_{ds}T_{ds}A_{ds}T_{ds}A_{ds}G_{ds}T_{ds}A_{ks}T_{es}G_{ks}G_{es}T_{k}$ (SEQ ID NO: 120), wherein:

A=an adenine nucleobase,
G=a guanine nucleobase,
T=a thymine nucleobase,
e=a 2'-MOE sugar moiety,
k=a cEt modified sugar moiety
d=a 2'-β-D-deoxyribosyl sugar moiety,
o=a phosphodiester internucleoside linkage,
s=a phosphorothioate internucleoside linkage, and

[C16 - HA] =

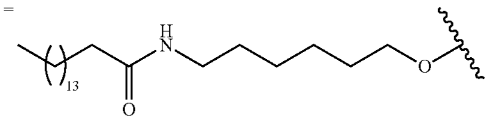

Certain Oligomeric Compounds

An oligomeric compound comprising a conjugate group and the following chemical structure:

(SEQ ID NO: 185)

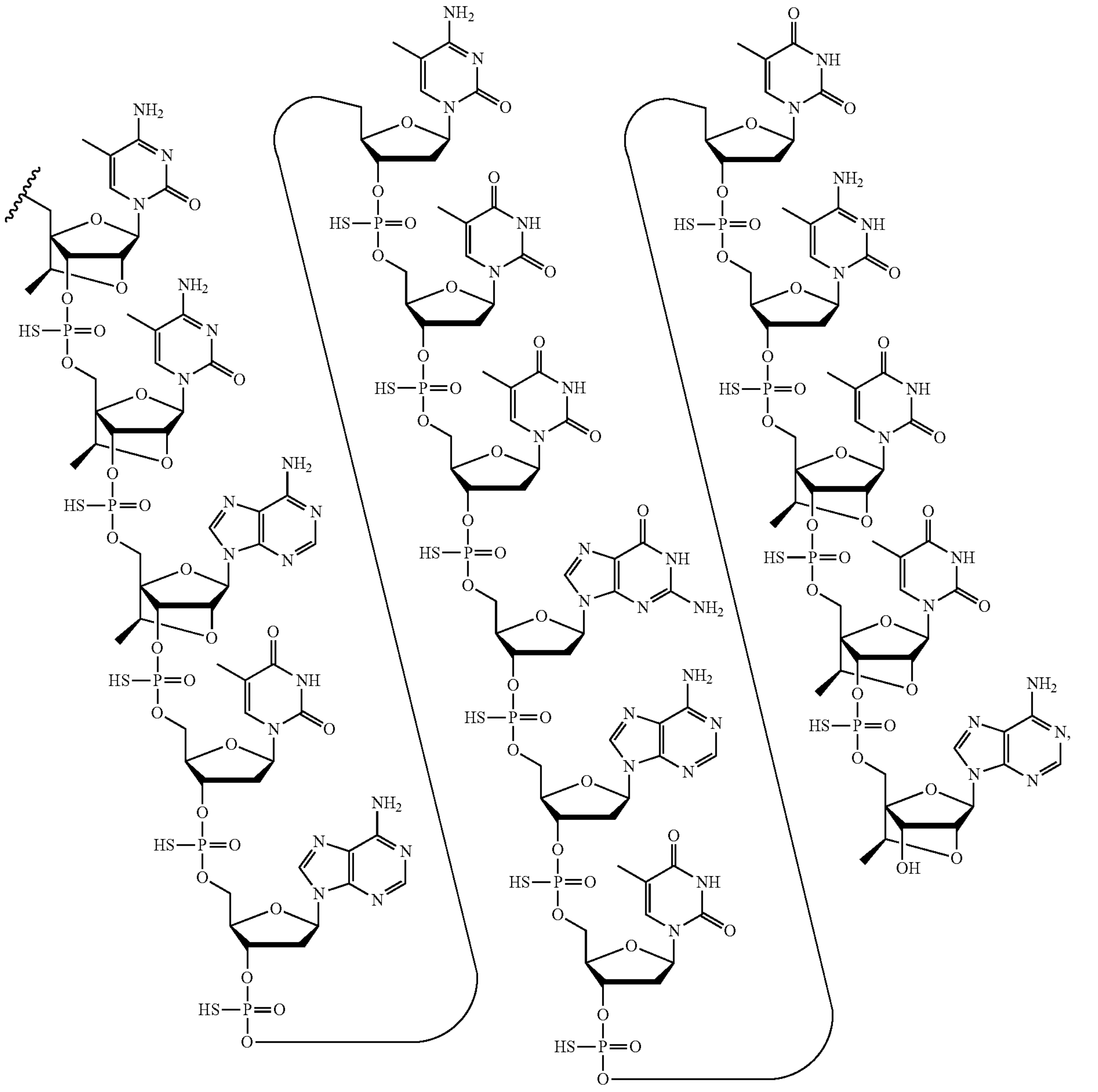

or a salt thereof. In certain embodiments, the oligomeric compound is the sodium salt or potassium salt. In certain embodiments, the conjugate group comprises a cell-targeting moiety having an affinity for transferrin receptor (TfR), also known as TfR1 and CD71. In certain embodiments, the conjugate group comprises an anti-TfR1 antibody or fragment thereof. In certain embodiments, the conjugate group comprises a protein or peptide capable of binding TfR1. In certain embodiments, the conjugate group comprises an aptamer capable of binding TfR1.

An oligomeric compound comprising a conjugate group and the following chemical structure:

(SEQ ID NO: 752)

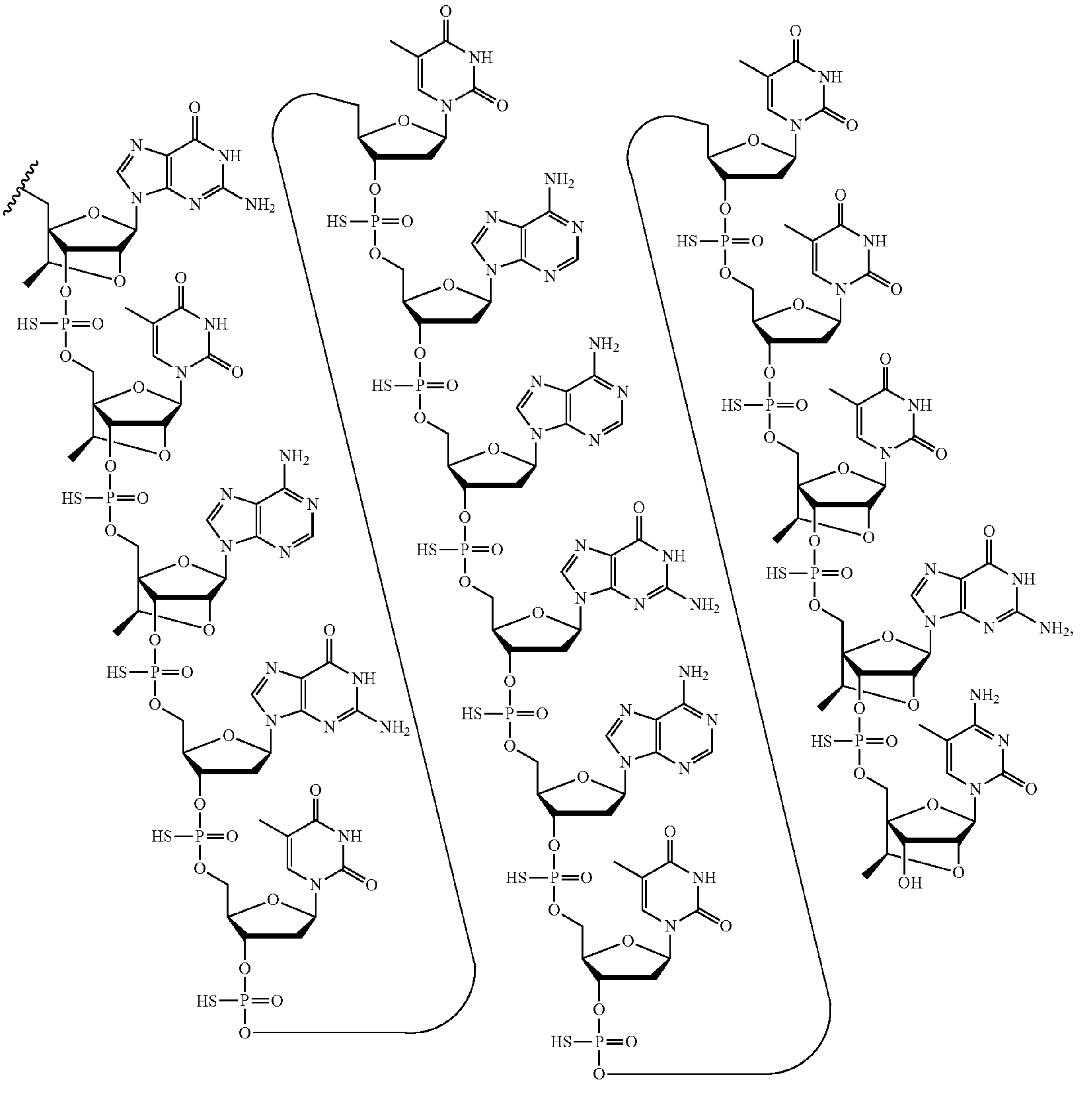

or a salt thereof. In certain embodiments, the oligomeric compound is the sodium salt or potassium salt. In certain embodiments, the conjugate group comprises a cell-targeting moiety having an affinity for transferrin receptor (TfR), also known as TfR1 and CD71. In certain embodiments, the conjugate group comprises an anti-TfR1 antibody or fragment thereof. In certain embodiments, the conjugate group comprises a protein or peptide capable of binding TfR1. In certain embodiments, the conjugate group comprises an aptamer capable of binding TfR1.

An oligomeric compound comprising a conjugate group and the following chemical structure:

(SEQ ID NO: 609)

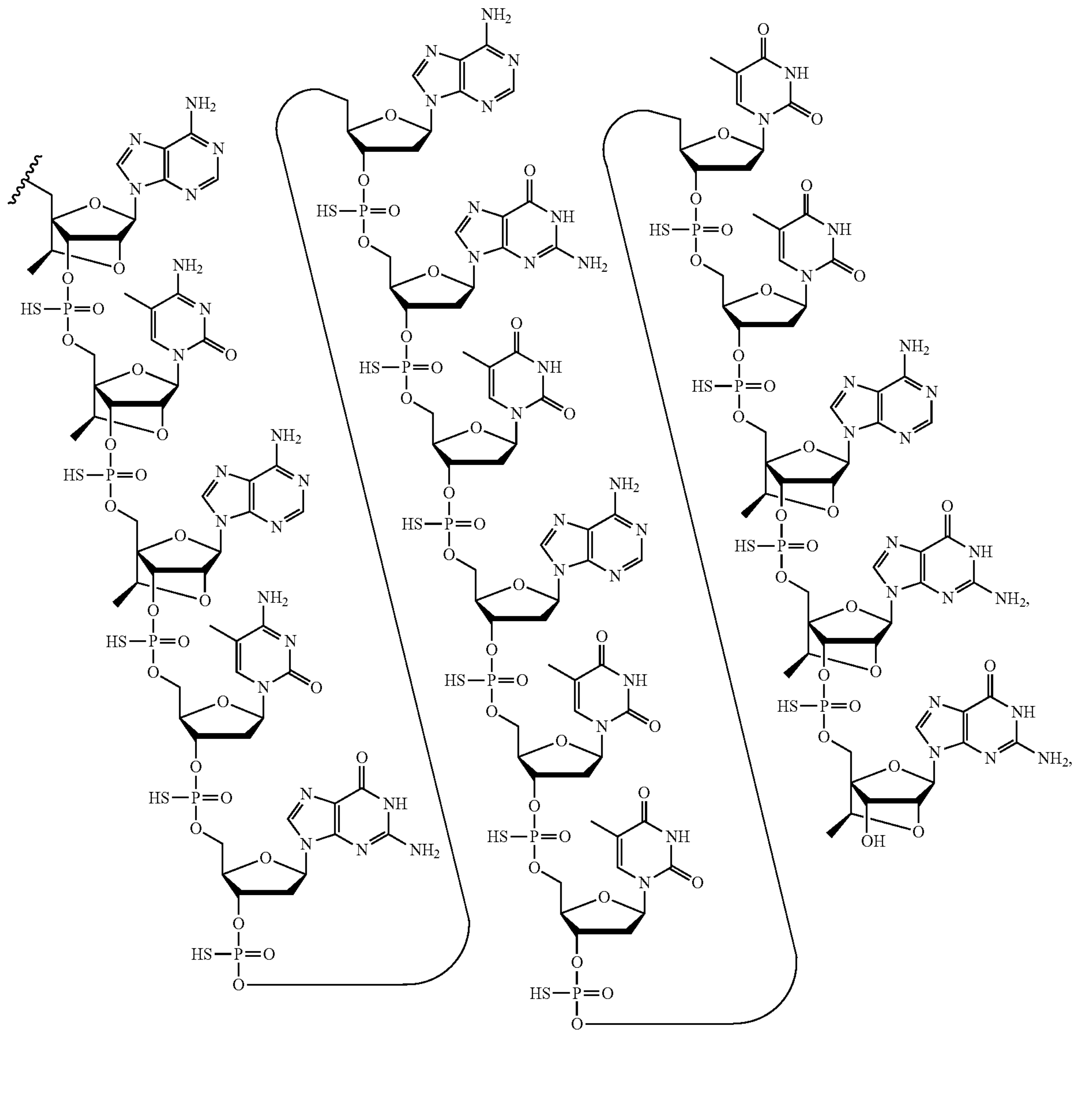

or a salt thereof. In certain embodiments, the oligomeric compound is the sodium salt or potassium salt. In certain embodiments, the conjugate group comprises a cell-targeting moiety having an affinity for transferrin receptor (TfR), also know asn TfR1 and CD71. In certain embodiments, the conjugate group comprises an anti-TfR1 antibody or fragment thereof. In certain embodiments, the conjugate group comprises a protein or peptide capable of binding TfR1. In certain embodiments, the conjugate group comprises an aptamer capable of binding TfR1.

An oligomeric compound comprising a conjugate group and the following chemical structure:

(SEQ ID NO: 45)

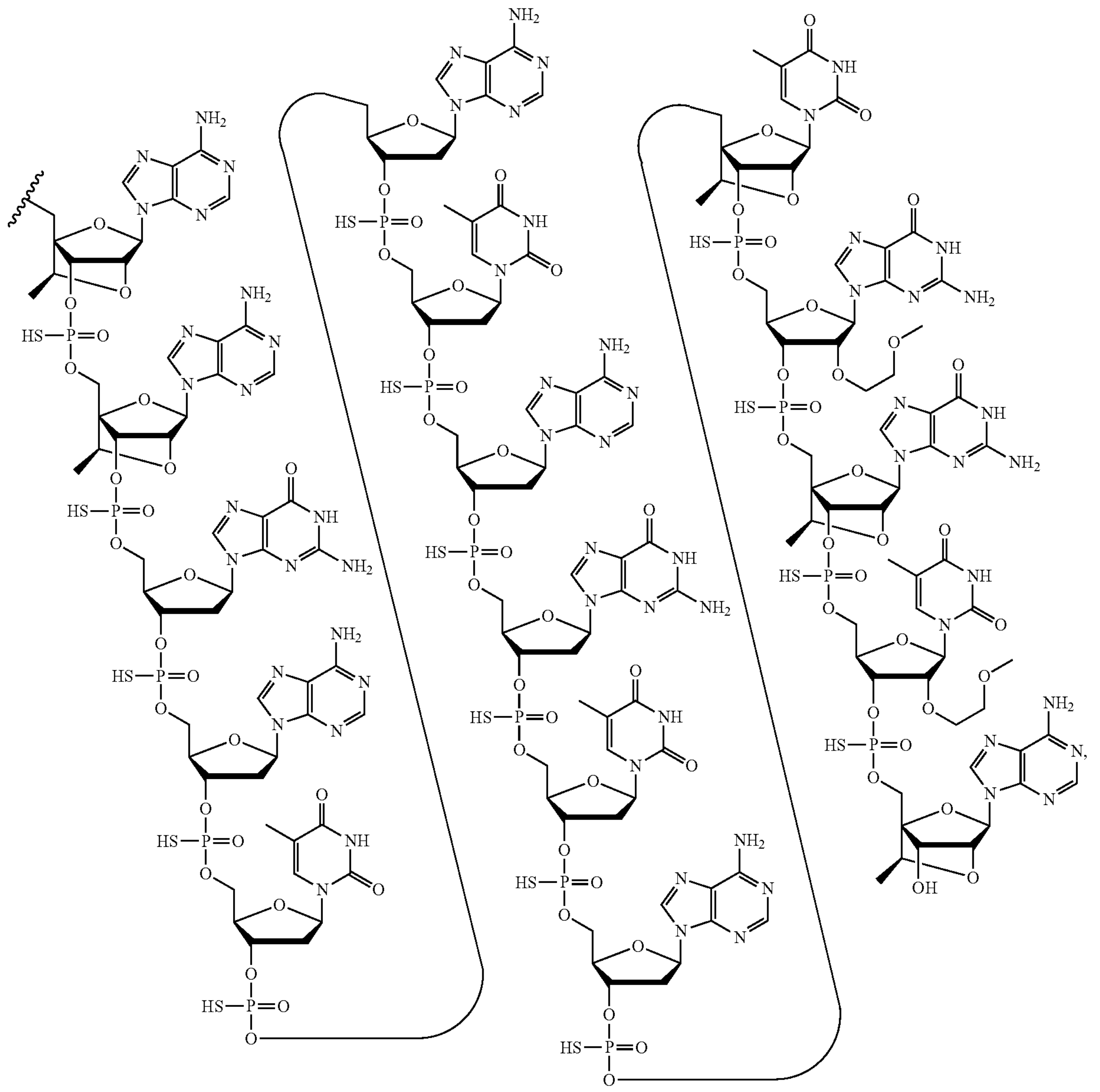

or a salt thereof. In certain embodiments, the oligomeric compound is the sodium salt or potassium salt. In certain embodiments, the conjugate group comprises a cell-targeting moiety having an affinity for transferrin receptor (TfR), also known as TfR1 and CD71. In certain embodiments, the conjugate group comprises an anti-TfR1 antibody or fragment thereof. In certain embodiments, the conjugate group comprises a protein or peptide capable of binding TfR1. In certain embodiments, the conjugate group comprises an aptamer capable of binding TfR1.

An oligomeric compound comprising a conjugate group and the following chemical structure:

(SEQ ID NO: 737)

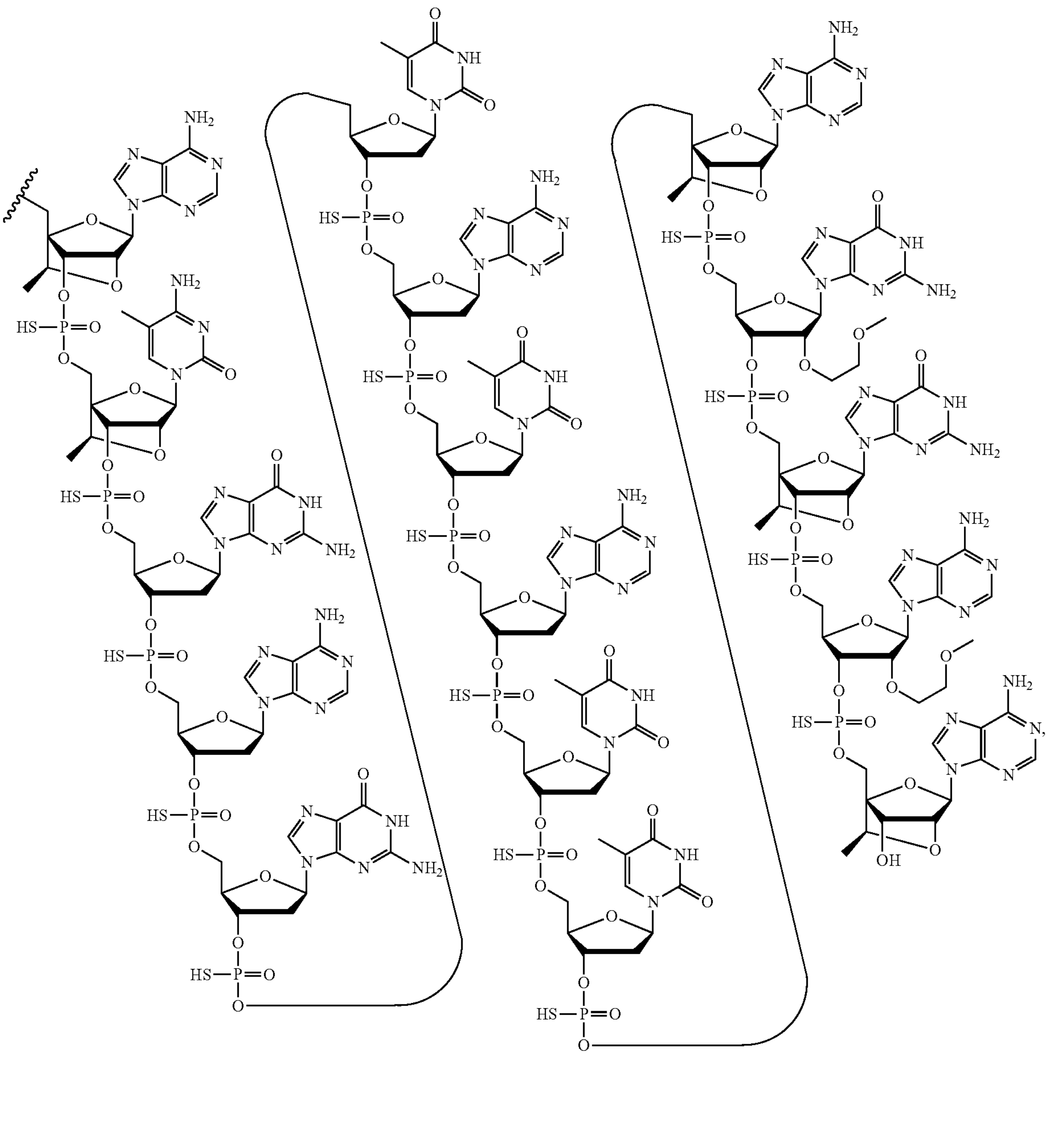

or a salt thereof. In certain embodiments, the oligomeric compound is the sodium salt or potassium salt. In certain embodiments, the conjugate group comprises a cell-targeting moiety having an affinity for transferrin receptor (TfR), also known as TfR1 and CD71. In certain embodiments, the conjugate group comprises an anti-TfR1 antibody or fragment thereof. In certain embodiments, the conjugate group comprises a protein or peptide capable of binding TfR1. In certain embodiments, the conjugate group comprises an aptamer capable of binding TfR1.

An oligomeric compound comprising a conjugate group and the following chemical structure:

(SEQ ID NO: 120)

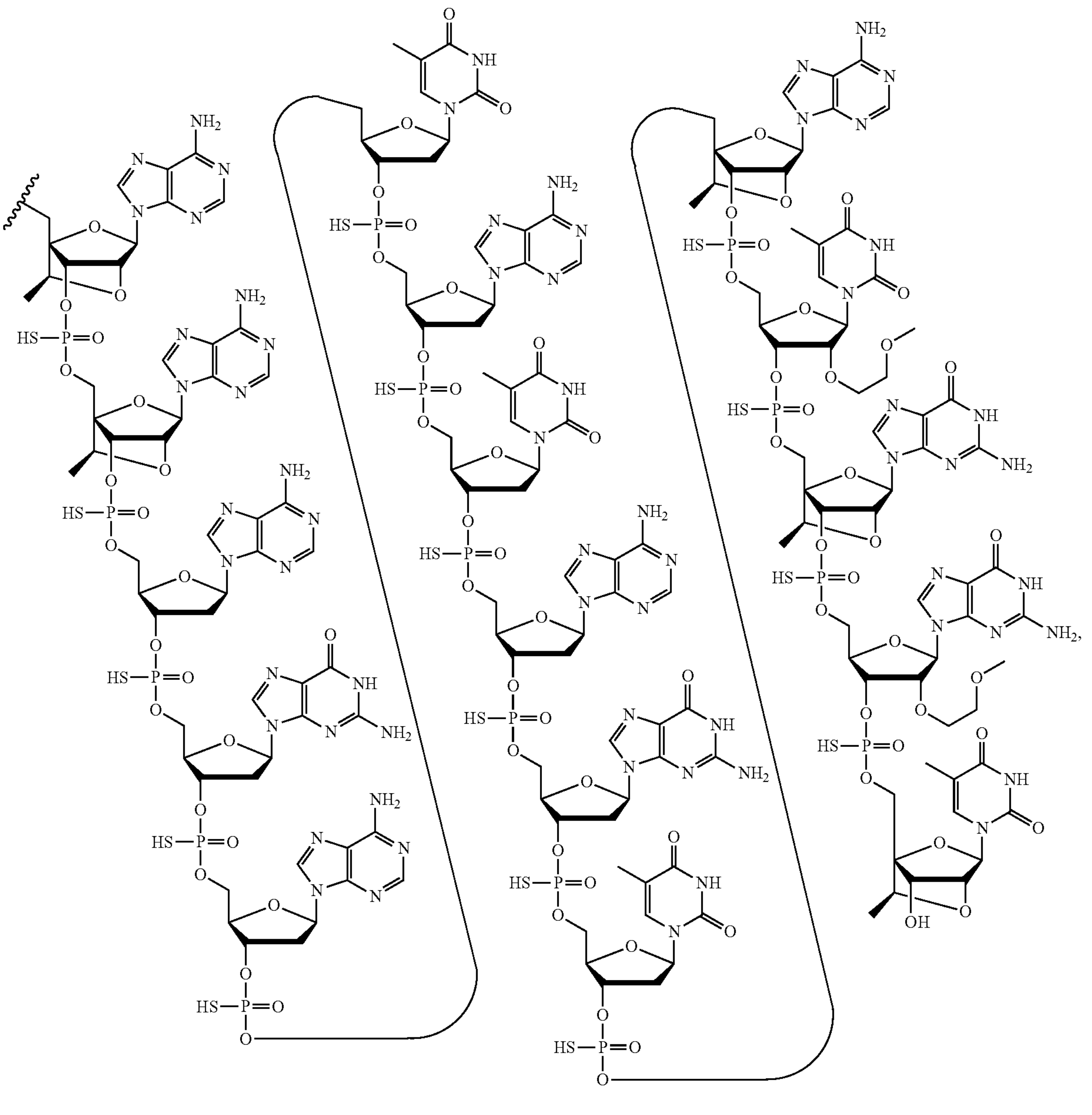

or a salt thereof. In certain embodiments, the oligomeric compound is the sodium salt or potassium salt. In certain embodiments, the conjugate group comprises a cell-targeting moiety having an affinity for transferrin receptor (TfR), also known as TfR1 and CD71. In certain embodiments, the conjugate group comprises an anti-TfR1 antibody or fragment thereof. In certain embodiments, the conjugate group comprises a protein or peptide capable of binding TfR1. In certain embodiments, the conjugate group comprises an aptamer capable of binding TfR1.

An oligomeric compound comprising a conjugate group and the following chemical structure:

(SEQ ID NO: 675)

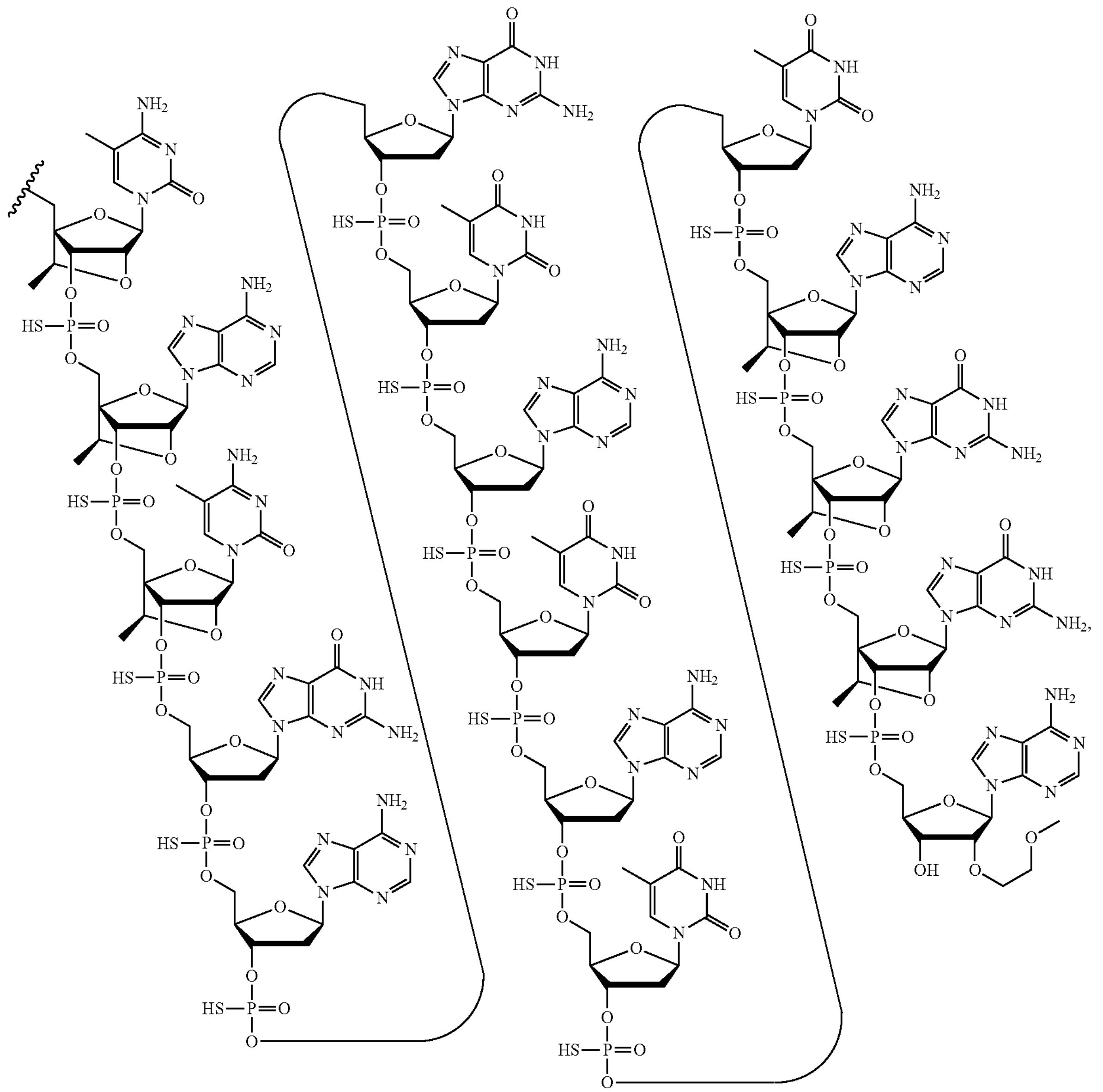

or a salt thereof. In certain embodiments, the oligomeric compound is the sodium salt or potassium salt. In certain embodiments, the conjugate group comprises a cell-targeting moiety having an affinity for transferrin receptor (TfR), also known as TfR1 and CD71. In certain embodiments, the conjugate group comprises an anti-TfR1 antibody or fragment thereof. In certain embodiments, the conjugate group comprises a protein or peptide capable of binding TfR1. In certain embodiments, the conjugate group comprises an aptamer capable of binding TfR1.

Certain Oligomeric Duplexes

Certain embodiments are directed to oligomeric duplexes comprising a first oligomeric compound and a second oligomeric compound.

In certain embodiments, an oligomeric duplex comprises:

a first oligomeric compound comprising a first modified oligonucleotide consisting of 8 to 80 linked nucleosides, wherein the nucleobase sequence of the first modified oligonucleotide is at least 80% complementary to an equal length portion within nucleobases 3278-3293, 3281-3296, 3282-3297, 3284-3299, 3286-3301, 3287-3302, 3288-3303, 3327-3342, 3329-3344, 3332-3347, 3333-3348, 3336-3351, 3337-3352, 3338-3353, 3339-3354, 3340-3355, 3341-3356, 3343-3358, 3345-3360, 3348-3363, 3349-3364, 3350-3365, 3351-3366, 3352-3367, 3353-3368, 3354-3369, 3355-3370, 3356-3371, 3357-3372, 3358-3373, 3395-3410, 3396-3411, 3405-3420, 3406-3421, 3408-3423, 3409-3424, 3410-3425, 3412-3427, 3496-3511, 3497-3512, 3498-3513, 3499-3514, 3598-3613, 3612-3627, 3614-3629, 3615-3630, 3616-3631, 3617-3632, 3618-3633, 3619-3634, 3620-3635, 3622-3637, 3703-3718, 3704-3719, 3715-3730, 3716-3731, 3723-3738, 3724-3739, 3799-3814, 3801-3816, 3802-3817, 3803-3818, 3804-3819, 3805-3820, 3806-3821, 3807-3822, 3808-3823, 3809-3824, 3811-3826, 3814-3829, 3815-3830, 3816-3831, 3817-3832, 3821-3836, 3823-3838, 3830-3845, 3831-3846, 3848-3863, 3849-3864, 3850-3865, 3851-3866, 3861-3876, 3863-3878, 3864-3879, 3869-3884, 3871-3886, 3976-3991, 3977-3992, 3978-3993, 3980-3995, 3981-3996, 4116-4131, 4159-4174, 4204-4219, 4207-4222, 4208-4223, 4209-4224, 4210-4225, 4211-4226, 4212-4227, 4214-4229, 4221-4236, 4231-4246, 4232-4247, 4233-4248, 4234-4249, 4235-4250, 4236-4251, 4238-4253, 4252-4267, 4253-4268, 4266-4281, 4348-4363, 4349-4364, 4350-4365, 4367-4382, 4373-4388, 4374-4389, 4375-4390, 4510-4525, 4511-4526, 4513-4528, 4515-4530, 4516-4531, 4517-4532, 4518-4533, 4519-4534, 4530-4545, 4537-4552, 4539-4554, 4540-4555, 4541-4556, 4542-4557, 4543-4558, 4544-4559, 4545-4560, 4562-4577, 4614-4629, 4617-4632, 4619-4634, 4620-4635, 4621-4636, 4622-4637, 4623-4638, 4624-4639, 4638-4653, 4640-4655, 4641-4656, 4642-4657, 4643-4658, 4665-4680, 4672-4687, 4693-4708, 4694-4709, 4695-4710, 4696-4711, 4697-4712, 4750-4765, 4751-4766, 4752-4767, 4753-4768, 4774-4789, 4802-4817, 4804-4819, 4805-4820, 4806-4821, 4807-4822, 4823-4838, 4825-4840, 4826-4841, 4828-4843, 4860-4875, 4862-4877, 4869-4884, 4872-4887, 4874-4889, 4878-4893, 4881-4896, 4883-4898, 4884-4899, 4942-4957, 4943-4958, 4945-4960, 4946-4961, 4957-4972, 4958-4973, 4960-4975, 4961-4976, 4964-4979, 4965-4980, 4966-4981, 4968-4983, 4969-4984, 4971-4986, 4972-4987, 4974-4989, 4984-4999, 4985-5000, 4987-5002, 4988-5003, 5024-5039, 5127-5142, 5133-5148, 5134-5149, 5158-5173, 5159-5174, 5160-5175, 5163-5178, 5294-5309, 5341-5356, 5359-5374, 5394-5409, 5399-5414, 5400-5415, 5401-5416, 5402-5417, 5404-5419, 5411-5426, 5413-5428, 5414-5429, 5415-5430, 5416-5431, 5417-5432, 5418-5433, 5419-5434, 5421-5436, 5427-5442, 5428-5443, 5489-5504, 5494-5509, 5495-5510, 5497-5512, 5498-5513, 5498-5515, 5498-5517, 5499-5514, 5499-5515, 5499-5516, 5499-5518, 5500-5515, 5500-5516, 5500-5517, 5501-5516, 5501-5514, 5501-5517, 5502-5517, 5502-5515, 5503-5518, 5504-5519, 5505-5520, 5506-5521, 5511-5526, 5532-5547, 5533-5548, 5534-5549, 5547-5562, 5557-5572, 5558-5573, 5559-5574, 5560-5575, 5562-5577, 5563-5578, 5565-5580, 5599-5614, 5673-5688, 5674-5689, 5675-5690, 5676-5691, 5677-5692, 5678-5693, 5679-5694, 5694-5709, 5695-5710, 5696-5711, 5697-5712, 5698-5713, 5774-5789, 5827-5842, 5845-5860, 5847-5862, 5848-5863, 5850-5865, 5851-5866, 5855-5870, 5859-5874, 5924-5939, 5925-5940, 5926-5941, 5927-5942, 5929-5944, 5930-5945, 5931-5946, 5932-5947, 6008-6023, 6009-6024, 6039-6054, 6053-6068, 6054-6069, 6055-6070, 6059-6074, 6066-6081, 6069-6084, 6070-6085, 6076-6091, 6092-6107, 6098-6113, 6112-6127, 6114-6129, 6117-6132, 6118-6133, 6119-6134, 6124-6139, 6125-6140, 6126-6141, 6147-6162, 6154-6169, 6155-6170, 6156-6171, 6157-6172, 6176-6191, 6177-6192, 6185-6200, 6186-6201, 6187-6202, 6188-6203, 6202-6217, 6209-6224, 6243-6258, 6249-6264, 6267-6282, 6268-6283, 6274-6289, 6275-6290, 6291-6306, 6338-6353, 6352-6367, 6353-6368, 6354-6369, 6365-6380, 6366-6381, 6368-6383, 6369-6384, 6403-6418, 6405-6420, 6406-6421, 6407-6422, 6408-6423, 6409-6424, 6410-6425, 6411-6426, 6413-6428, 6468-6483, 6471-6486, 6502-6517, 6546-6561, 6554-6569, 6555-6570, 6556-6571, 6557-6572, 6569-6584, 6574-6589, 6575-6590, 6576-6591, 6577-6592, 6578-6593, 6579-6594, 6644-6659, 6646-6661, 6647-6662, 6664-6679, 6665-6680, 6666-6681, 6667-6682, 6676-6691, 6677-6692, 6746-6761, 6804-6819, 6806-6821, 6825-6840, 6826-6841, 6827-6842, 6828-6843, 6831-6846, 6833-6848, 6834-6849, 6875-6890, 6877-6892, 6879-6894, 6880-6895, 6881-6896, 6893-6908, 6896-6911, 6898-6913, 6899-6914, 6900-6915, 6901-6916, 6903-6918, 6904-6919, 6906-6921, 6907-6922, 6908-6923, 6920-6935, 6921-6936, 6922-6937, 6923-6938, 6927-6942, 6928-6943, 6930-6945, 6937-6952, 6939-6954, 6940-6955, 6941-6956, 6942-6957, 6943-6958, 6944-6959, 6945-6960, 6947-6962, 6965-6980, 6966-6981, 6967-6982, 6968-6983, 6972-6987, 6975-6990, 7029-7044, 7042-7057, 7047-7062, 7050-7065, 7073-7088, 7082-7097, 7083-7098, 7102-7117, 7106-7121, 7107-7122, 7108-7123, 7120-7135, 7122-7137, 7123-7138, 7124-7139, 7125-7140, 7126-7141, 7128-7143, 7129-7144, 7130-7145, 7131-7146, 7279-7294, 7280-7295, 7282-7297, 7283-7298, 7284-7299, 7285-7300, 7286-7301, 7287-7302, 7320-7335, 7341-7356, 7342-7357, 7344-7359, 7353-7368, 7354-7369, 7356-7371, 7357-7372, 7358-7373, 7359-7374, 7360-7375, 7361-7376, 7362-7377, 7377-7392, 7378-7393, 7392-7407, 7393-7408, 7411-7426, 7425-7440, 7436-7451, 7457-7472, 7458-7473, 7459-7474, 7460-7475, 7461-7476, 7463-7478, 7464-7479, 7470-7485, 7516-7531, 7518-7533, 7519-7534, 7520-7535, 7521-7536, 7522-7537, 7546-7561, 7548-7563, 7553-7568, 7554-7569, 7555-7570, 7556-7571, 7558-7573, 7560-7575, 7561-7576, 7562-7577, 7563-7578, 7564-7579, 7565-7580, 7566-7581, 7568-7583, 7587-7602, 7588-7603, 7589-7604, 7595-7610, 7638-7653, 7679-7694, 7726-7741, 7779-7794, 7797-7812, 7799-7814, 7806-7821, 7857-7872, 7859-7874, 7860-7875, 7861-7876, 7862-7877, 7863-7878, 7864-7879, 7865-7880, 7867-7882, 7876-7891, 7878-7893, 7888-7903, 7889-7904, 7893-7908, 7908-7923, 7929-7944, 7965-7980, 7967-7982, 7968-7983, 8047-8062, 8058-8073, 8061-8076, 8089-8104, 8090-8105, 8163-8178, 8182-8197, 8194-8209, 8195-8210, 8196-8211, 8197-8212, 8284-8299, 8285-8300, 8286-8301, 8287-8302, 8288-8303, 8326-8341, 8336-8351, 8352-8367, 8353-8368, 8368-8383, 8393-8408, 8412-8427, 8413-8428, 8415-8430, 8418-8433, 8427-8442, 8447-8462, 8493-8508, 8494-8509, 8495-8510, 8496-8511, 8498-8513, 8542-8557, 8573-8588, 8621-8636, 8627-8642, 8628-8643, 8638-8653, 8639-8654, 8641-8656, 8653-8668, 8655-8670, 8703-8718, 8708-8723, 8732-8747, 8733-8748, 8739-8754, 8774-8789, 8776-8791, 8777-8792, 8818-8833, 8823-8838, 8824-8839, 8826-8841, 8827-8842, 8850-8865, 8855-8870, 8942-8957, 8943-8958, 8944-8959, 8955-8970, 8961-8976, 8962-8977, 8963-8978, 8964-8979, 9377-9392, 9443-9458, 9474-9489, 9523-9538, 9524-9539, 9525-9540, 9526-9541, 9528-9543, 9536-9551, 9537-9552, 9538-9553, 9540-9555, 9541-9556, 9545-9560, 9549-9564, 9550-9565, 9587-9602, 9630-9645, 9641-9656, 9642-9657, 9646-9661, 9647-9662, 9648-9663, 9649-9664, 9651-9666, 9660-9675, 9668-9683, 9669-9684, 9672-9687, 9697-9712, 9702-9717, 9703-9718, 9706-9721, 9707-9722, 9708-9723, 9709-9724, 9710-9725, 9711-9726, 9720-9735, 9727-9742, 9752-9767, 9756-9771, 9788-9803, 9934-9949, 9936-9951, 9937-9952, 9938-9953, 9939-9954, 9940-9955, 10019-10034, 10054-

10069, 10062-10077, 10081-10096, 10106-10121, 10117-10132, 10443-10458, 10444-10459, 10445-10460, 10480-10495, 10481-10496, 10486-10501, 10489-10504, 10490-10505, 10491-10506, 10532-10547, 10623-10638, 10638-10653, 10645-10660, 10718-10733, 10719-10734, 10720-10735, 10721-10736, 10722-10737, 10723-10738, 10724-10739, 10747-10762, 10770-10785, 11066-11081, 11068-11083, 11104-11119, 11111-11126, 11112-11127, 11115-11130, 11116-11131, 11118-11133, 11130-11145, 11144-11159, 11224-11239, 11225-11240, 11237-11252, 11258-11273, 11259-11274, 11302-11317, 11353-11368, 11356-11371, 11368-11383, 11369-11384, 11409-11424, 11410-11425, 11411-11426, 11412-11427, 11413-11428, 11414-11429, 11415-11430, 11417-11432, 11457-11472, 11458-11473, 11467-11482, 11474-11489, 11475-11490, 11509-11524, 11510-11525, 11511-11526, 11524-11539, 11525-11540, 11526-11541, 11527-11542, 11529-11544, 11530-11545, 11622-11637, 11631-11646, 11632-11647, 11633-11648, 11634-11649, 11635-11650, 11636-11651, 11639-11654, 11670-11685, 11678-11693, 11679-11694, 11680-11695, 11681-11696, 11682-11697, 11684-11699, 11685-11700, 11726-11741, 11727-11742, 11740-11755, 11741-11756, 11742-11757, 11743-11758, 11799-11814, 11832-11847, 11833-11848, 11854-11869, 11855-11870, 11856-11871, 11857-11872, 11858-11873, 11859-11874, 11900-11915, 11931-11946, 11956-11971, 11988-12003, 11989-12004, 11990-12005, 11991-12006, 11992-12007, 11993-12008, 11994-12009, 11995-12010, 11997-12012, 11998-12013, 11999-12014, 12000-12015, 12015-12030, 12016-12031, 12017-12032, 12027-12042, 12032-12047, 12040-12055, 12041-12056, 12042-12057, 12076-12091, 12080-12095, 12081-12096, 12082-12097, 12084-12099, 12085-12100, 12086-12101, 12087-12102, 12088-12103, 12089-12104, 12090-12105, 12092-12107, 12194-12209, 12195-12210, 12238-12253, 12239-12254, 12241-12256, 12242-12257, 12243-12258, 12246-12261, 12282-12297, 12283-12298, 12285-12300, 12286-12301, 12287-12302, 12288-12303, 12307-12322, 12308-12323, 12310-12325, 12312-12327, 12315-12330, 12348-12363, 12355-12370, 12356-12371, 12357-12372, 12368-12383, 12388-12403, 12389-12404, 12390-12405, 12391-12406, 12392-12407, 12470-12485, 12471-12486, 12472-12487, 12473-12488, 12474-12489, 12498-12513, 12529-12544, 12530-12545, 12546-12561, 12548-12563, 12550-12565, 12551-12566, 12585-12600, 12721-12736, 12722-12737, 12723-12738, 12724-12739, 12727-12742, 12732-12747, 12733-12748, 12734-12749, 12735-12750, 12760-12775, 12812-12827, 12813-12828, 12817-12832, 12818-12833, 12912-12927, 12915-12930, 12929-12944, 12943-12958, 12946-12961, 13243-13258, 13327-13342, 13409-13424, 13431-13446, 13438-13453, 13460-13475, 13461-13476, 13484-13499, 13485-13500, 13486-13501, 13489-13504, 13490-13505, 13491-13506, 13492-13507, 13493-13508, 13525-13540, 13528-13543, 13529-13544, 13530-13545, 13717-13732, 13736-13751, 13770-13785, 13776-13791, 13777-13792, 13786-13801, 13814-13829, 13816-13831, 13818-13833, 13819-13834, 13820-13835, 13821-13836, 13822-13837, 13823-13838, 13835-13850, 13836-13851, 13837-13852, 13838-13853, 13839-13854, 13843-13858, 13870-13885, 13872-13887, 13875-13890, 13876-13891, 13877-13892, 13878-13893, 13879-13894, 13880-13895, 13881-13896, 13882-13897, 13883-13898, 13885-13900, 13904-13919, 13905-13920, 13906-13921, 13907-13922, 13908-13923, 13910-13925, 13912-13927, 13918-13933, 13924-13939, 13926-13941, 13927-13942, 13930-13945, 13934-13949, 13935-13950, 13936-13951, 13937-13952, 13938-13953, 13939-13954, 13940-13955, 13941-13956, 13942-13957, 13943-13958, 13944-13959, 13945-13960, 13946-13961, 13952-13967, 13953-13968, 13954-13969, 13955-13970, 13956-13971, 13957-13972, 13958-13973, 13959-13974, 13960-13975, 13961-13976, 13962-13977, 13963-13978, 13964-13979, 13965-13980, 13966-13981, 13967-13982, 13968-13983, 13969-13984, 13970-13985, 13973-13988, 13976-13991, 14000-14015, 14003-14018, 14028-14043, 14030-14045, 14032-14047, 14035-14050, 14036-14051, 14038-14053, 14039-14054, 14040-14055, 14041-14056, 14045-14060, 14047-14062, 14048-14063, 14049-14064, 14050-14065, 14051-14066, 14053-14068, 14054-14069, 14055-14070, 14056-14071, 14059-14074, 14060-14075, 14061-14076, 14062-14077, 14063-14078, 14064-14079, 14065-14080, 14066-14081, 14078-14093, 14081-14096, 14082-14097, 14084-14099, 14085-14100, 14086-14101, 14087-14102, 14088-14103, 14089-14104, 14090-14105, 14091-14106, 14092-14107, 14093-14108, 14095-14110, 14096-14111, 14097-14112, 14098-14113, 14099-14114, 14100-14115, 14102-14117, 14105-14120, 14110-14125, 14111-14126, 14112-14127, 14113-14128, 14115-14130, 14117-14132, 14119-14134, 14130-14145, 14163-14178, 14165-14180, 14166-14181, 14167-14182, 14169-14184, 14170-14185, 14174-14189, 14180-14195, 14181-14196, 14203-14218, 14207-14222, 14209-14224, 14212-14227, 14217-14232, 14220-14235, 14222-14237, 14223-14238, 14224-14239, 14225-14240, 14232-14247, 14233-14248, 14235-14250, 14242-14257, 14244-14259, 14247-14262, 14248-14263, 14249-14264, 14250-14265, 14251-14266, 14252-14267, 14253-14268, 14254-14269, 14255-14270, 14256-14271, 14257-14272, 14316-14331, 14317-14332, 14318-14333, 14319-14334, 14321-14336, 14324-14339, 14327-14342, 14337-14352, 14338-14353, 14339-14354, 14340-14355, 14341-14356, 14342-14357, 14343-14358, 14344-14359, 14345-14360, 14346-14361, 14347-14362, 14398-14413, 14400-14415, 14401-14416, 14403-14418, 14404-14419, 14405-14420, 14406-14421, 14408-14423, 14409-14424, 14410-14425, 14412-14427, 14443-14458, 14479-14494, 14480-14495, 14482-14497, 14504-14519, 14507-14522, 14508-14523, 14509-14524, 14510-14525, 14511-14526, 14512-14527, 14513-14528, 14514-14529, 14515-14530, 14515-14532, 14515-14534, 14516-14531, 14516-14532, 14516-14533, 14517-14532, 14517-14533, 14518-14531, 14519-14534, 14520-14535, 14522-14537, 14534-14549, 14535-14550, 14553-14568, 14569-14584, 14570-14585, 14571-14586, 14573-14588, 14601-14616, 14602-14617, 14603-14618, 14605-14620, 14606-14621, 14607-14622, 14608-14623, 14609-14624, 14610-14625, 14611-14626, 14612-14627, 14613-14628, 14614-14629, 14615-14630, 14616-14631, 14655-14670, 14656-14671, 14658-14673, 14659-14674, 14681-14696, 14683-14698, 14684-14699, 14684-

14701, 14684-14703, 14685-14700, 14685-14701, 14685-14702, 14686-14701, 14686-14702, 14687-14702, 14687-14700, 14688-14703, 14689-14704, 14691-14706, 14692-14707, 14696-14711, 14703-14718, 14704-14719, 14705-14720, 14706-14721, 14707-14722, 14708-14723, 14709-14724, 14710-14725, 14711-14726, 14712-14727, 14713-14728, 14714-14729, 14759-14774, 14760-14775, 14761-14776, 14762-14777, 14763-14778, 14764-14779, 14765-14780, 14766-14781, 14767-14782, 14768-14783, 14769-14784, 14770-14785, 14771-14786, 14772-14787, 14773-14788, 14774-14789, 14775-14790, 14776-14791, 14779-14794, 14787-14802, 14792-14807, 14793-14808, 14794-14809, 14797-14812, 14798-14813, 14800-14815, 14818-14833, 14822-14837, 14823-14838, 14824-14839, 14825-14840, 14826-14841, 14827-14842, 14828-14843, 14829-14844, 14830-14845, 14831-14846, 14832-14847, 14833-14848, 14834-14849, 14835-14850, 14841-14856, 14842-14857, 14843-14858, 14844-14859, 14845-14860, 14846-14861, 14847-14862, 14848-14863, 14849-14864, 14850-14865, 14851-14866, 14852-14867, 14853-14868, 14855-14870, 14856-14871, 14857-14872, 14858-14873, 14859-14874, 14861-14876, 14862-14877, 14863-14878, 14864-14879, 14866-14881, 14877-14892, 14878-14893, 14880-14895, 14881-14896, 14889-14904, 14898-14913, 14899-14914, 14901-14916, 14903-14918, 14904-14919, 14905-14920, 14906-14921, 14913-14928, 14915-14930, 14916-14931, 14917-14932, 14918-14933, 14919-14934, 14921-14936, 14922-14937, 14923-14938, 14924-14939, 14925-14940, 14926-14941, 14927-14942, 14928-14943, 14929-14944, 14930-14945, 14931-14946, 14932-14947, 14933-14948, 14934-14949, 14935-14950, 14936-14951, 14937-14952, 14938-14953, 14938-14955, 14938-14957, 14939-14954, 14939-14955, 14939-14956, 14939-14958, 14940-14955, 14940-14956, 14940-14957, 14940-14959, 14941-14956, 14941-14954, 14941-14957, 14941-14958, 14941-14960, 14942-14957, 14942-14955, 14942-14958, 14942-14959, 14942-14961, 14943-14958, 14943-14956, 14943-14959, 14943-14960, 14943-14962, 14944-14959, 14944-14957, 14944-14960, 14944-14961, 14945-14960, 14945-14958, 14945-14961, 14946-14961, 14946-14959, 14948-14963, 14956-14971, 14957-14972, 14958-14973, 14959-14974, 14960-14975, 14961-14976, 14962-14977, 14963-14978, 14964-14979, 14965-14980, 14966-14981, 14968-14983, 14969-14984, 14970-14985, 14987-15002, 14992-15007, 14993-15008, 14994-15009, 14995-15010, 14996-15011, 15003-15018, 15005-15020, 15006-15021, 15007-15022, 15008-15023, 15009-15024, 15010-15025, 15011-15026, 15012-15027, 15013-15028, 15014-15029, 15015-15030, 15016-15031, 15017-15032, 15019-15034, 15142-15157, 15143-15158, 15150-15165, 15151-15166, 15152-15167, 15153-15168, 15154-15169, 15155-15170, 15156-15171, 15157-15172, 15158-15173, 15159-15174, 15160-15175, 15161-15176, 15162-15177, 15163-15178, 15164-15179, 15182-15197, 15184-15199, 15185-15200, 15186-15201, 15195-15210, 15197-15212, 15198-15213, 15199-15214, 15200-15215, 15201-15216, 15202-15217, 15203-15218, 15204-15219, 15205-15220, 15206-15221, 15207-15222, 15208-15223, 15209-15224, 15210-15225, 15211-15226, 15214-15229, 15215-15230, 15216-15231, 15217-15232, 15218-15233, 15219-15234, 15220-15235, 15221-15236, 15222-15237, 15222-15239, 15222-15241, 15223-15238, 15223-15239, 15223-15240, 15224-15239, 15224-15240, 15225-15240, 15225-15238, 15227-15242, 15228-15243, 15229-15244, 15230-15245, 15231-15246, 15232-15247, 15233-15248, 15234-15249, 15235-15250, 15236-15251, 15237-15252, 15238-15253, 15239-15254, 15247-15262, 15248-15263, 15249-15264, 15250-15265, 15251-15266, 15252-15267, 15253-15268, 15254-15269, 15255-15270, 15256-15271, 15257-15272, 15258-15273, 15259-15274, 15260-15275, 15261-15276, 15293-15308, 15299-15314, 15301-15316, 15302-15317, 15303-15318, 15304-15319, 15305-15320, 15320-15335, 15321-15336, 15323-15338, 15411-15426, 15414-15429, 15415-15430, 15416-15431, 15417-15432, 15496-15511, 15501-15516, 15504-15519, 15505-15520, 15506-15521, 15507-15522, 15508-15523, 15509-15524, 15510-15525, 15511-15526, 15512-15527, 15513-15528, 15515-15530, 15556-15571, 15558-15573, 15559-15574, 15560-15575, 15562-15577, 15569-15584, 15571-15586, 15574-15589, 15593-15608, 15594-15609, 15595-15610, 15596-15611, 15598-15613, 15599-15614, 15600-15615, 15601-15616, 15602-15617, 15603-15618, 15604-15619, 15605-15620, 15627-15642, 15629-15644, 15630-15645, 15631-15646, 15632-15647, 15633-15648, 15635-15650, 15636-15651, 15639-15654, 15640-15655, 15641-15656, 15642-15657, 15658-15673, 15659-15674, 15660-15675, 15661-15676, 15665-15680, 15666-15681, 15667-15682, 15668-15683, 15671-15686, 15673-15688, 15674-15689, 15675-15690, 15681-15696, 15682-15697, 15683-15698, 15684-15699, 15685-15700, 15686-15701, 15687-15702, 15740-15755, 15741-15756, 15753-15768, 15757-15772, 15758-15773, 15761-15776, 15762-15777, 15763-15778, 15765-15780, 15788-15803, 15812-15827, 15813-15828, 15814-15829, 15815-15830, 15816-15831, 15826-15841, 15827-15842, 15833-15848, 15858-15873, 15861-15876, 15863-15878, 15864-15879, 15865-15880, 15866-15881, 15867-15882, 15868-15883, 15869-15884, 15870-15885, 15871-15886, 15872-15887, 15873-15888, 15874-15889, 15875-15890, 15876-15891, 15877-15892, 15878-15893, 15882-15897, 15883-15898, 15910-15925, 15911-15926, 15912-15927, 15913-15928, 15914-15929, 15943-15958, 15947-15962, 15949-15964, 15950-15965, 15951-15966, 15955-15970, 15973-15988, 15974-15989, 15979-15994, 15980-15995, 16000-16015, 16008-16023, 16010-16025, 16026-16041, 16027-16042, 16030-16045, 16032-16047, 16034-16049, 16036-16051, 16037-16052, 16038-16053, 16039-16054, 16056-16071, 16057-16072, 16080-16095, 16117-16132, 16118-16133, 16216-16231, 16248-16263, 16265-16280, 16266-16281, 16268-16283, 16269-16284, 16273-16288, 16300-16315, 16305-16320, 16306-16321, 16327-16342, 16329-16344, 16422-16437, 16427-16442, 16428-16443, 16550-16565, 16557-16572, 16564-16579, 16569-16584, 16582-16597, 16592-16607, 16617-16632, or 16676-16691 of SEQ ID NO: 2. of SEQ ID NO: 2; and a second oligomeric compound comprising a second modified oligonucleotide consisting of 8 to 80 linked nucleosides wherein the nucleobase sequence of the second modified oligonucleotide comprises a complementary region of at least 8 nucleobases that is at least 90% complementary to an equal length portion of the first modified oligonucleotide.

In certain embodiments, an oligomeric duplex comprises:

a first oligomeric compound comprising a first modified oligonucleotide consisting of 8 to 80 linked nucleosides, wherein the nucleobase sequence of the first modified oligonucleotide is at least 80% complementary to an equal length portion within nucleobases 3341-3368, 4516-4533, 5498-5517, 14337-14357, 14569-14588, 14607-14631, 14683-14703, 14828-14848, 14939-14958, 15222-15243, or 15251-15273 of SEQ ID NO: 2; and a second oligomeric compound comprising a second modified oligonucleotide consisting of 8 to 80 linked nucleosides wherein the nucleobase sequence of the second modified oligonucleotide comprises a complementary region of at least 8 nucleobases that is at least 90% complementary to an equal length portion of the first modified oligonucleotide.

In certain embodiments, an oligomeric duplex comprises:

a first oligomeric compound comprising a first modified oligonucleotide consisting of 8 to 80 linked nucleosides wherein the nucleobase sequence of the first modified oligonucleotide comprises at least 8, at least 9, at least 10, at least 11, at least 12, at least 13, at least 14, at least 15, or at least 16 contiguous nucleobases of the nucleobase sequence of any of SEQ ID NOs: 15-1712, wherein each thymine is replaced by uracil; and a second oligomeric compound comprising a second modified oligonucleotide consisting of 8 to 80 linked nucleosides wherein the nucleobase sequence of the second modified oligonucleotide comprises a complementary region of at least 8 nucleobases that is at least 90% complementary to an equal length portion of the first modified oligonucleotide.

In certain embodiments, the first oligomeric compound is an antisense compound. In certain embodiments, the first modified oligonucleotide is an antisense oligonucleotide. In certain embodiments, the second oligomeric compound is a sense compound. In certain embodiments, the second modified oligonucleotide is a sense oligonucleotide.

In certain embodiments, an oligomeric duplex comprises:

a first oligomeric compound comprising a first modified oligonucleotide consisting of 14 to 80 linked nucleosides wherein the nucleobase sequence of the first modified oligonucleotide comprises the nucleobase sequence of any of SEQ ID NOs: 15-1712, wherein each thymine is replaced by uracil; and a second oligomeric compound comprising a second modified oligonucleotide consisting of 14 to 80 linked nucleosides wherein the nucleobase sequence of the second modified oligonucleotide comprises a complementary region of at least 16 nucleobases that is at least 90% complementary to an equal length portion of the first modified oligonucleotide.

In certain embodiments, the first oligomeric compound is an antisense compound. In certain embodiments, the first modified oligonucleotide is an antisense oligonucleotide. In certain embodiments, the second oligomeric compound is a sense compound. In certain embodiments, the second modified oligonucleotide is a sense oligonucleotide.

In certain embodiments, an oligomeric duplex comprises:

a first oligomeric compound comprising a first modified oligonucleotide consisting of 19 to 29 linked nucleosides wherein the nucleobase sequence of the first modified oligonucleotide comprises at least 8, at least 9, at least 10, at least 11, at least 12, at least 13, at least 14, at least 15, at least 16, at least 17, at least 18, at least 19, at least 20, at least 21, at least 22, or at least 23 contiguous nucleobases of the nucleobase sequence of any of SEQ ID NOs: 1713-2024; and a second oligomeric compound comprising a second modified oligonucleotide consisting of 15 to 29 linked nucleosides wherein the nucleobase sequence of the second modified oligonucleotide comprises a complementary region of at least 8 nucleobases that is at least 90% complementary to an equal length portion of the first modified oligonucleotide.

In certain embodiments, the first oligomeric compound is an antisense compound. In certain embodiments, the first modified oligonucleotide is an antisense oligonucleotide. In certain embodiments, the second oligomeric compound is a sense compound. In certain embodiments, the second modified oligonucleotide is a sense oligonucleotide.

In certain embodiments, an oligomeric duplex comprises:

a first oligomeric compound comprising a first modified oligonucleotide consisting of 19 to 29 linked nucleosides wherein the nucleobase sequence of the first modified oligonucleotide comprises at least 8, at least 9, at least 10, at least 11, at least 12, at least 13, at least 14, at least 15, at least 16, at least 17, at least 18, at least 19, at least 20, at least 21, at least 22, or at least 23 contiguous nucleobases of the nucleobase sequence of any of SEQ ID NOs: 1713-2024; and a second oligomeric compound comprising a second modified oligonucleotide consisting of 15 to 29 linked nucleosides wherein the nucleobase sequence of the second modified oligonucleotide comprises at least 8, at least 9, at least 10, at least 11, at least 12, at least 13, at least 14, at least 15, at least 16, at least 17, at least 18, at least 19, at least 20, or at least 21 contiguous nucleobases of the nucleobase sequence of any of SEQ ID NOs: 2025-2336, wherein the nucleobase sequence of the second modified oligonucleotide is at least 90% complementary to an equal length portion of the first modified oligonucleotide.

In certain embodiments, the first oligomeric compound is an antisense compound. In certain embodiments, the first modified oligonucleotide is an antisense oligonucleotide. In certain embodiments, the second oligomeric compound is a sense compound. In certain embodiments, the second modified oligonucleotide is a sense oligonucleotide.

In certain embodiments, an oligomeric duplex comprises:

a first oligomeric compound comprising a first modified oligonucleotide consisting of 23 linked nucleosides wherein the nucleobase sequence of the first modified oligonucleotide consists of the nucleobase sequence of any of SEQ ID NOs: 1713-2024; and a second oligomeric compound comprising a second modified oligonucleotide consisting of 21 linked nucleosides wherein the nucleobase sequence of the second modified oligonucleotide consists of the nucleobase sequence of any of SEQ ID NOs: 2025-2336, wherein the nucleobase sequence of the second modified oligonucleotide is at least 90% complementary to an equal length portion of the first modified oligonucleotide.

In certain embodiments, the first oligomeric compound is an antisense compound. In certain embodiments, the first modified oligonucleotide is an antisense oligonucleotide. In certain embodiments, the second oligomeric compound is a sense compound. In certain embodiments, the second modified oligonucleotide is a sense oligonucleotide.

In certain embodiments, an oligomeric duplex comprises a first oligomeric compound comprising a first modified oligonucleotide, wherein the nucleobase sequence of the modified oligonucleotide is at least 80% complementary, for example, at least 80%, at least 85%, at least 90%, or at least 95% to an equal length portion within nucleobases 34-56, 44-66, 54-76, 64-86, 74-96, 84-106, 94-116, 104-126, 114-136, 124-146, 134-156, 144-166, 154-176, 164-186, 174-196, 184-206, 194-216, 204-226, 214-236, 224-246, 234-256, 244-266, 254-276, 264-286, 274-296, 284-306, 294-316, 304-326, 314-336, 324-346, 334-356, 344-366, 354-376, 364-386, 374-396, 384-406, 394-416, 404-426, 414-436, 424-446, 434-456, 444-466, 454-476, 464-486, 474-496, 484-506, 494-516, 504-526, 514-536, 524-546, 534-556, 544-566, 554-576, 564-586, 574-596, 584-606, 594-616, 604-626, 614-636, 624-646, 634-656, 644-666, 654-676, 664-686, 674-696, 684-706, 694-716, 704-726, 714-736, 724-746, 734-756, 744-766, 754-776, 764-786, 774-796, 784-806, 794-816, 804-826, 814-836, 819-841, 834-856, 844-866, 854-876, 864-886, 874-896, 884-906, 894-916, 904-926, 914-936, 924-946, 934-956, 944-966, 954-976, 964-986, 974-996, 984-1006, 994-1016, 1004-1026, 1014-1036, 1024-1046, 1034-1056, 1044-1066, 1054-1076, 1064-1086, 1074-1096, 1084-1106, 1094-1116, 1104-1126, 1114-1136, 1124-1146, 1134-1156, 1144-1166, 1154-1176, 1164-1186, 1174-1196, 1184-1206, 1194-1216, 1204-1226, 1214-1236, 1224-1246, 1234-1256, 1238-1260, 1243-1265, 1248-1270, 1254-1276, 1264-1286, 1274-1296, 1279-1301, 1284-1306, 1294-1316, 1304-1326, 1314-1336, 1324-1346, 1334-1356, 1344-1366, 1354-1376, 1364-1386, 1374-1396, 1384-1406, 1394-1416, 1404-1426, 1414-1436, 1424-1446, 1434-1456, 1444-1466, 1454-1476, 1464-1486, 1474-1496, 1484-1506, 1494-1516, 1499-1521, 1504-1526, 1514-1536, 1522-1544, 1534-1556, 1544-1566, 1554-1576, 1564-1586, 1574-1596, 1584-1606, 1594-1616, 1604-1626, 1614-1636, 1624-1646, 1634-1656, 1644-1666, 1654-1676, 1664-1686, 1674-1696, 1684-1706, 1694-1716, 1704-1726, 1714-1736, 1724-1746, 1734-1756, 1744-1766, 1754-1776, 1764-1786, 1774-1796, 1784-1806, 1794-1816, 1804-1826, 1814-1836, 1824-1846, 1834-1856, 1844-1866, 1854-1876, 1864-1886, 1874-1896, 1884-1906, 1894-1916, 1904-1926, 1914-1936, 1924-1946, 1934-1956, 1944-1966, 1954-1976, 1964-1986, 1974-1996, 1984-2006, 1994-2016, 2004-2026, 2014-2036, 2019-2041, 2024-2046, 2034-2056, 2044-2066, 2054-2076, 2064-2086, 2074-2096, 2084-2106, 2094-2116, 2104-2126, 2114-2136, 2124-2146, 2134-2156, 2144-2166, 2154-2176, 2164-2186, 2174-2196, 2184-2206, 2194-2216, 2204-2226, 2214-2236, 2219-2241, 2224-2246, 2234-2256, 2244-2266, 2254-2276, 2264-2286, 2274-2296, 2284-2306, 2294-2316, 2304-2326, 2314-2336, 2324-2346, 2334-2356, 2344-2366, 2354-2376, 2364-2386, 2374-2396, 2379-2401, 2384-2406, 2394-2416, 2404-2426, 2414-2436, 2424-2446, 2434-2456, 2444-2466, 2454-2476, 2464-2486, 2474-2496, 2479-2501, 2484-2506, 2494-2516, 2504-2526, 2514-2536, 2524-2546, 2534-2556, 2544-2566, 2554-2576, 2564-2586, 2574-2596, 2584-2606, 2594-2616, 2604-2626, 2614-2636, 2619-2641, 2624-2646, 2634-2656, 2644-2666, 2654-2676, 2664-2686, 2674-2696, 2684-2706, 2694-2716, 2699-2721, 2704-2726, 2714-2736, 2724-2746, 2734-2756, 2744-2766, 2754-2776, 2759-2781, 2764-2786, 2774-2796, 2784-2806, 2794-2816, 2804-2826, 2814-2836, 2824-2846, 2834-2856, 2844-2866, 2854-2876, 2864-2886, 2874-2896, 2879-2901, 2884-2906, 2894-2916, 2904-2926, 2914-2936, 2919-2941, 2924-2946, 2934-2956, 2944-2966, 2954-2976, 2964-2986, 2974-2996, 2981-3003, 2987-3009, or 2994-3016, of SEQ ID NO: 1.

In certain embodiments, an oligomeric duplex comprises a first oligomeric compound comprising a first modified oligonucleotide consisting of 19 to 29 linked nucleosides and a second oligomeric compound comprising a second modified oligonucleotide consisting of 15 to 29 linked nucleosides, wherein the nucleobase sequence of the first modified oligonucleotide and the nucleobase sequence of the second modified oligonucleotide each comprises at least 8, at least 9, at least 10, at least 11, at least 12, at least 13, at least 14, at least 15, at least 16, at least 17, at least 18, at least 19, at least 20, at least 21, at least 22, or at least 23 contiguous nucleobases of any of the following pairs of nucleobase sequences recited in SEQ ID NOs: 1713/2025, 1714/2026, 1715/2027, 1716/2028, 1717/2029, 1718/2030, 1719/2031, 1720/2032, 1721/2033, 1722/2034, 1723/2035, 1724/2036, 1725/2037, 1726/2038, 1727/2039, 1728/2040, 1729/2041, 1730/2042, 1731/2043, 1732/2044, 1733/2045, 1734/2046, 1735/2047, 1736/2048, 1737/2049, 1738/2050, 1739/2051, 1740/2052, 1741/2053, 1742/2054, 1743/2055, 1744/2056, 1745/2057, 1746/2058, 1747/2059, 1748/2060, 1749/2061, 1750/2062, 1751/2063, 1752/2064, 1753/2065, 1754/2066, 1755/2067, 1756/2068, 1757/2069, 1758/2070, 1759/2071, 1760/2072, 1761/2073, 1762/2074, 1763/2075, 1764/2076, 1765/2077, 1766/2078, 1767/2079, 1768/2080, 1769/2081, 1770/2082, 1771/2083, 1772/2084, 1773/2085, 1774/2086, 1775/2087, 1776/2088, 1777/2089, 1778/2090, 1779/2091, 1780/2092, 1781/2093, 1782/2094, 1783/2095, 1784/2096, 1785/2097, 1786/2098, 1787/2099, 1788/2100, 1789/2101, 1790/2102, 1791/2103, 1792/2104, 1793/2105, 1794/2106, 1795/2107, 1796/2108, 1797/2109, 1798/2110, 1799/2111, 1800/2112, 1801/2113, 1802/2114, 1803/2115, 1804/2116, 1805/2117, 1806/2118, 1807/2119, 1808/2120, 1809/2121, 1810/2122, 1811/2123, 1812/2124, 1813/2125, 1814/2126, 1815/2127, 1816/2128, 1817/2129, 1818/2130, 1819/2131, 1820/2132, 1821/2133, 1822/2134, 1823/2135, 1824/2136, 1825/2137, 1826/2138, 1827/2139, 1828/2140, 1829/2141, 1830/2142, 1831/2143, 1832/2144, 1833/2145, 1834/2146, 1835/2147, 1836/2148, 1837/2149, 1838/2150, 1839/2151, 1840/2152, 1841/2153, 1842/2154, 1843/2155, 1844/2156, 1845/2157, 1846/2158, 1847/2159, 1848/2160, 1849/2161, 1850/2162, 1851/2163, 1852/2164, 1853/2165, 1854/2166, 1855/2167, 1856/2168, 1857/2169, 1858/2170, 1859/2171, 1860/2172, 1861/2173, 1862/2174, 1863/2175, 1864/2176, 1865/2177, 1866/2178, 1867/2179, 1868/2180, 1869/2181, 1870/2182, 1871/2183, 1872/2184, 1873/2185, 1874/2186, 1875/2187, 1876/2188, 1877/2189, 1878/2190, 1879/2191, 1880/2192, 1881/2193, 1882/2194, 1883/2195, 1884/2196, 1885/2197, 1886/2198, 1887/2199, 1888/2200, 1889/2201, 1890/2202, 1891/2203, 1892/2204, 1893/2205, 1894/2206, 1895/2207, 1896/2208, 1897/2209, 1898/2210, 1899/2211, 1900/2212, 1901/2213, 1902/2214, 1903/2215, 1904/2216, 1905/2217, 1906/2218, 1907/2219, 1908/2220, 1909/2221, 1910/2222, 1911/2223, 1912/2224, 1913/2225, 1914/2226, 1915/2227, 1916/2228, 1917/2229, 1918/2230, 1919/2231, 1920/2232, 1921/2233, 1922/2234, 1923/2235, 1924/2236, 1925/2237, 1926/2238, 1927/2239, 1928/2240, 1929/2241, 1930/2242, 1931/2243, 1932/2244, 1933/2245, 1934/2246, 1935/2247, 1936/2248, 1937/2249, 1938/2250, 1939/2251, 1940/2252, 1941/2253, 1942/2254, 1943/2255, 1944/2256, 1945/2257, 1946/2258, 1947/2259, 1948/2260, 1949/2261, 1950/2262, 1951/2263, 1952/2264, 1953/2265, 1954/2266, 1955/2267, 1956/2268, 1957/2269, 1958/2270, 1959/2271, 1960/2272, 1961/2273, 1962/2274, 1963/2275, 1964/2276, 1965/2277, 1966/2278, 1967/2279, 1968/2280, 1969/2281, 1970/2282, 1971/2283, 1972/2284, 1973/2285, 1974/2286, 1975/2287, 1976/2288, 1977/2289, 1978/2290, 1979/2291, 1980/2292, 1981/2293, 1982/2294, 1983/2295, 1984/2296, 1985/2297, 1986/2298, 1987/2299, 1988/2300, 1989/2301, 1990/2302, 1991/2303, 1992/2304, 1993/2305, 1994/2306, 1995/2307, 1996/2308, 1997/2309, 1998/2310, 1999/2311, 2000/2312, 2001/2313, 2002/2314, 2003/2315, 2004/2316, 2005/2317, 2006/2318, 2007/2319, 2008/2320, 2009/2321, 2010/2322, 2011/2323, 2012/2324, 2013/2325, 2014/2326, 2015/2327, 2016/2328, 2017/2329, 2018/2330, 2019/2331, 2020/2332, 2021/2333, 2022/2334, 2023/2335, or 2024/2336, wherein the nucleobase sequence of the first modified oligonucleotide comprises the nucleobase sequence of the first SEQ ID NO recited in the pair and the nucleobase sequence of the second modified oligonucleotide comprises the nucleobase sequence of the second SEQ ID NO recited in the pair. In certain embodiments, the first oligomeric compound is an antisense compound. In certain embodiments, the first modified oligonucleotide is an antisense oligonucleotide. In certain embodiments, the second oligomeric compound is a sense compound. In certain embodiments, the second modified oligonucleotide is a sense oligonucleotide.

In certain embodiments, an oligomeric duplex comprises a first oligomeric compound comprising a first modified oligonucleotide consisting of 19 to 29 linked nucleosides and a second oligomeric compound comprising a second modified oligonucleotide consisting of 15 to 29 linked nucleosides, wherein the nucleobase sequences of the first modified oligonucleotide and second modified oligonucleotide comprise any of the following pairs of nucleobase sequences recited in SEQ ID NOs: 1713/2025, 1714/2026, 1715/2027, 1716/2028, 1717/2029, 1718/2030, 1719/2031, 1720/2032, 1721/2033, 1722/2034, 1723/2035, 1724/2036, 1725/2037, 1726/2038, 1727/2039, 1728/2040, 1729/2041, 1730/2042, 1731/2043, 1732/2044, 1733/2045, 1734/2046, 1735/2047, 1736/2048, 1737/2049, 1738/2050, 1739/2051, 1740/2052, 1741/2053, 1742/2054, 1743/2055, 1744/2056, 1745/2057, 1746/2058, 1747/2059, 1748/2060, 1749/2061, 1750/2062, 1751/2063, 1752/2064, 1753/2065, 1754/2066, 1755/2067, 1756/2068, 1757/2069, 1758/2070, 1759/2071, 1760/2072, 1761/2073, 1762/2074, 1763/2075, 1764/2076, 1765/2077, 1766/2078, 1767/2079, 1768/2080, 1769/2081, 1770/2082, 1771/2083, 1772/2084, 1773/2085, 1774/2086, 1775/2087, 1776/2088, 1777/2089, 1778/2090, 1779/2091, 1780/2092, 1781/2093, 1782/2094, 1783/2095, 1784/2096, 1785/2097, 1786/2098, 1787/2099, 1788/2100, 1789/2101, 1790/2102, 1791/2103, 1792/2104, 1793/2105, 1794/2106, 1795/2107, 1796/2108, 1797/2109, 1798/2110, 1799/2111, 1800/2112, 1801/2113, 1802/2114, 1803/2115, 1804/2116, 1805/2117, 1806/2118, 1807/2119, 1808/2120, 1809/2121, 1810/2122, 1811/2123, 1812/2124, 1813/2125, 1814/2126, 1815/2127, 1816/2128, 1817/2129, 1818/2130, 1819/2131, 1820/2132, 1821/2133, 1822/2134, 1823/2135, 1824/2136, 1825/2137, 1826/2138, 1827/2139, 1828/2140, 1829/2141, 1830/2142, 1831/2143, 1832/2144, 1833/2145, 1834/2146, 1835/2147, 1836/2148, 1837/2149, 1838/2150, 1839/2151, 1840/2152, 1841/2153, 1842/2154, 1843/2155, 1844/2156, 1845/2157, 1846/2158, 1847/2159, 1848/2160, 1849/2161, 1850/2162, 1851/2163, 1852/2164, 1853/2165, 1854/2166, 1855/2167, 1856/2168, 1857/2169, 1858/2170, 1859/2171, 1860/2172, 1861/2173, 1862/2174, 1863/2175, 1864/2176, 1865/2177, 1866/2178, 1867/2179, 1868/2180, 1869/2181, 1870/2182, 1871/2183, 1872/2184, 1873/2185, 1874/2186, 1875/2187, 1876/2188, 1877/2189, 1878/2190, 1879/2191, 1880/2192, 1881/2193, 1882/2194, 1883/2195, 1884/2196, 1885/2197, 1886/2198, 1887/2199, 1888/2200, 1889/2201, 1890/2202, 1891/2203, 1892/2204, 1893/2205, 1894/2206, 1895/2207, 1896/2208, 1897/2209, 1898/2210, 1899/2211, 1900/2212, 1901/2213, 1902/2214, 1903/2215, 1904/2216, 1905/2217, 1906/2218, 1907/2219, 1908/2220, 1909/2221, 1910/2222, 1911/2223, 1912/2224, 1913/2225, 1914/2226, 1915/2227, 1916/2228, 1917/2229, 1918/2230, 1919/2231, 1920/2232, 1921/2233, 1922/2234, 1923/2235, 1924/2236, 1925/2237, 1926/2238, 1927/2239, 1928/2240, 1929/2241, 1930/2242, 1931/2243, 1932/2244, 1933/2245, 1934/2246, 1935/2247, 1936/2248, 1937/2249, 1938/2250, 1939/2251, 1940/2252, 1941/2253, 1942/2254, 1943/2255, 1944/2256, 1945/2257, 1946/2258, 1947/2259, 1948/2260, 1949/2261, 1950/2262, 1951/2263, 1952/2264, 1953/2265, 1954/2266, 1955/2267, 1956/2268, 1957/2269, 1958/2270, 1959/2271, 1960/2272, 1961/2273, 1962/2274, 1963/2275, 1964/2276, 1965/2277, 1966/2278, 1967/2279, 1968/2280, 1969/2281, 1970/2282, 1971/2283, 1972/2284, 1973/2285, 1974/2286, 1975/2287, 1976/2288, 1977/2289, 1978/2290, 1979/2291, 1980/2292, 1981/2293, 1982/2294, 1983/2295, 1984/2296, 1985/2297, 1986/2298, 1987/2299, 1988/2300, 1989/2301, 1990/2302, 1991/2303, 1992/2304, 1993/2305, 1994/2306, 1995/2307, 1996/2308, 1997/2309, 1998/2310, 1999/2311, 2000/2312, 2001/2313, 2002/2314, 2003/2315, 2004/2316, 2005/2317, 2006/2318, 2007/2319, 2008/2320, 2009/2321, 2010/2322, 2011/2323, 2012/2324, 2013/2325, 2014/2326, 2015/2327, 2016/2328, 2017/2329, 2018/2330, 2019/2331, 2020/2332, 2021/2333, 2022/2334, 2023/2335, or 2024/2336, wherein the nucleobase sequence of the first modified oligonucleotide comprises the nucleobase sequence of the first SEQ ID NO recited in the pair and the nucleobase sequence of the second modified oligonucleotide comprises the nucleobase sequence of the second SEQ ID NO recited in the pair. In certain embodiments, the first oligomeric compound is an antisense compound. In certain embodiments, the first modified oligonucleotide is an antisense oligonucleotide. In certain embodiments, the second oligomeric compound is a sense compound. In certain embodiments, the second modified oligonucleotide is a sense oligonucleotide.

In certain embodiments, an oligomeric duplex comprises a first oligomeric compound comprising a first modified oligonucleotide consisting of 23 linked nucleosides and a second oligomeric compound comprising a second modified oligonucleotide consisting of 21 linked nucleosides, wherein the nucleobase sequences of the first modified oligonucleotide and second modified oligonucleotide consist of any of the following pairs of nucleobase sequences recited in SEQ ID NOs: 1713/2025, 1714/2026, 1715/2027, 1716/2028, 1717/2029, 1718/2030, 1719/2031, 1720/2032, 1721/2033, 1722/2034, 1723/2035, 1724/2036, 1725/2037, 1726/2038, 1727/2039, 1728/2040, 1729/2041, 1730/2042, 1731/2043, 1732/2044, 1733/2045, 1734/2046, 1735/2047, 1736/2048, 1737/2049, 1738/2050, 1739/2051, 1740/2052, 1741/2053, 1742/2054, 1743/2055, 1744/2056, 1745/2057, 1746/2058, 1747/2059, 1748/2060, 1749/2061, 1750/2062, 1751/2063, 1752/2064, 1753/2065, 1754/2066, 1755/2067, 1756/2068, 1757/2069, 1758/2070, 1759/2071, 1760/2072, 1761/2073, 1762/2074, 1763/2075, 1764/2076, 1765/2077, 1766/2078, 1767/2079, 1768/2080, 1769/2081, 1770/2082, 1771/2083, 1772/2084, 1773/2085, 1774/2086, 1775/2087, 1776/2088, 1777/2089, 1778/2090, 1779/2091, 1780/2092, 1781/2093, 1782/2094, 1783/2095, 1784/2096, 1785/2097, 1786/2098, 1787/2099, 1788/2100, 1789/2101, 1790/2102, 1791/2103, 1792/2104, 1793/2105, 1794/2106, 1795/2107, 1796/2108, 1797/2109, 1798/2110, 1799/2111, 1800/2112, 1801/2113, 1802/2114, 1803/2115, 1804/2116, 1805/2117, 1806/2118, 1807/2119, 1808/2120, 1809/2121, 1810/2122, 1811/2123, 1812/2124, 1813/2125, 1814/2126, 1815/2127, 1816/2128, 1817/2129, 1818/2130, 1819/2131, 1820/2132, 1821/2133, 1822/2134, 1823/2135, 1824/2136, 1825/2137, 1826/2138, 1827/2139, 1828/2140, 1829/2141, 1830/2142, 1831/2143, 1832/2144, 1833/2145, 1834/2146, 1835/2147, 1836/2148, 1837/2149, 1838/2150, 1839/2151, 1840/2152, 1841/2153, 1842/2154, 1843/2155, 1844/2156, 1845/2157, 1846/2158, 1847/2159, 1848/2160, 1849/2161, 1850/2162, 1851/2163, 1852/2164, 1853/2165, 1854/2166, 1855/2167, 1856/2168, 1857/2169, 1858/2170, 1859/2171, 1860/2172, 1861/2173, 1862/2174, 1863/2175, 1864/2176, 1865/2177, 1866/2178, 1867/2179, 1868/2180, 1869/2181, 1870/2182, 1871/2183, 1872/2184, 1873/2185, 1874/2186, 1875/2187, 1876/2188, 1877/2189, 1878/2190, 1879/2191, 1880/2192, 1881/2193, 1882/2194, 1883/2195, 1884/2196, 1885/2197, 1886/2198, 1887/2199, 1888/2200, 1889/2201, 1890/2202, 1891/2203, 1892/2204, 1893/2205, 1894/2206, 1895/2207, 1896/2208, 1897/2209, 1898/2210, 1899/2211, 1900/2212, 1901/2213, 1902/2214, 1903/2215, 1904/2216, 1905/2217, 1906/2218, 1907/2219, 1908/2220, 1909/2221, 1910/2222, 1911/2223, 1912/2224, 1913/2225, 1914/2226, 1915/2227, 1916/2228, 1917/2229, 1918/2230, 1919/2231, 1920/2232, 1921/2233, 1922/2234, 1923/2235, 1924/2236, 1925/2237, 1926/2238, 1927/2239, 1928/2240, 1929/2241, 1930/2242, 1931/2243, 1932/2244, 1933/2245, 1934/2246, 1935/2247, 1936/2248, 1937/2249, 1938/2250, 1939/2251, 1940/2252, 1941/2253, 1942/2254, 1943/2255, 1944/2256, 1945/2257, 1946/2258, 1947/2259, 1948/2260, 1949/2261, 1950/2262, 1951/2263, 1952/2264, 1953/2265, 1954/2266, 1955/2267, 1956/2268, 1957/2269, 1958/2270, 1959/2271, 1960/2272, 1961/2273, 1962/2274, 1963/2275, 1964/2276, 1965/2277, 1966/2278, 1967/2279, 1968/2280, 1969/2281, 1970/2282, 1971/2283, 1972/2284, 1973/2285, 1974/2286, 1975/2287, 1976/2288, 1977/2289, 1978/2290, 1979/2291, 1980/2292, 1981/2293, 1982/2294, 1983/2295, 1984/2296, 1985/2297, 1986/2298, 1987/2299, 1988/2300, 1989/2301, 1990/2302, 1991/2303, 1992/2304, 1993/2305, 1994/2306, 1995/2307, 1996/2308, 1997/2309, 1998/2310, 1999/2311, 2000/2312, 2001/2313, 2002/2314, 2003/2315, 2004/2316, 2005/2317, 2006/2318, 2007/2319, 2008/2320, 2009/2321, 2010/2322, 2011/2323, 2012/2324, 2013/2325, 2014/2326, 2015/2327, 2016/2328, 2017/2329, 2018/2330, 2019/2331, 2020/2332, 2021/2333, 2022/2334, 2023/2335, or 2024/2336, wherein the nucleobase sequence of the first modified oligonucleotide comprises the nucleobase sequence of the first SEQ ID NO recited in the pair and the nucleobase sequence of the second modified oligonucleotide comprises the nucleobase sequence of the second SEQ ID NO recited in the pair. In certain embodiments, the first oligomeric compound is an antisense compound. In certain embodiments, the first modified oligonucleotide is an antisense oligonucleotide. In certain embodiments, the second oligomeric compound is a sense compound. In certain embodiments, the second modified oligonucleotide is a sense oligonucleotide.

In any of the oligomeric duplexes described herein, at least one nucleoside of the first modified oligonucleotide and/or the second modified oligonucleotide can comprise a modified sugar moiety. Examples of suitable modified sugar moieties include, but are not limited to, a bicyclic sugar moiety, such as a 2'-4' bridge selected from —O—CH2-; and —O—CH(CH3)-, and a non-bicyclic sugar moiety, such as a 2'-MOE sugar moiety, a 2'-F sugar moiety, a 2'-OMe sugar moiety, or a 2'-NMA sugar moiety. In certain embodiments, at least 80%, at least 90%, or 100% of the nucleosides of the first modified oligonucleotide and/or the second modified oligonucleotide comprises a modified sugar moiety selected from 2'-F and 2'-OMe.

In any of the oligomeric duplexes described herein, at least one nucleoside of the first modified oligonucleotide and/or the second modified oligonucleotide can comprise a sugar surrogate. Examples of suitable sugar surrogates include, but are not limited to, morpholino, peptide nucleic acid (PNA), glycol nucleic acid (GNA), and unlocked nucleic acid (UNA). In certain embodiments, at least one nucleoside of the first modified oligonucleotide comprises a sugar surrogate, which can be a GNA.

In any of the oligomeric duplexes described herein, at least one internucleoside linkage of the first modified oligonucleotide and/or the second modified oligonucleotide can comprise a modified internucleoside linkage. In certain embodiments, the modified internucleoside linkage is a phosphorothioate internucleoside linkage. In certain embodiments, at least one of the first, second, or third internucleoside linkages from the 5' end and/or the 3' end of the first modified oligonucleotide comprises a phosphorothioate linkage. In certain embodiments, at least one of the first, second, or third internucleoside linkages from the 5' end and/or the 3' end of the second modified oligonucleotide comprises a phosphorothioate linkage.

In any of the oligomeric duplexes described herein, at least one internucleoside linkage of the first modified oligonucleotide and/or the second modified oligonucleotide can comprise a phosphodiester internucleoside linkage. In any of the oligomeric duplexes described herein, at least one internucleoside linkage of the first modified oligonucleotide and/or the second modified oligonucleotide can comprise a mesyl phosphoramidate internucleoside linkage.

In any of the oligomeric duplexes described herein, each internucleoside linkage of the first modified oligonucleotide and/or the second modified oligonucleotide can be independently selected from a phosphodiester or a phosphorothioate internucleoside linkage. In any of the oligomeric duplexes described herein, each internucleoside linkage of the first modified oligonucleotide and/or the second modified oligonucleotide can be independently selected from a phosphodiester, a phosphorothioate internucleoside, or a mesyl phosphoramidate internucleoside linkage.

In any of the oligomeric duplexes described herein, the internucleoside linkage motif of the second modified oligonucleotide can be ssooooooooooooooooss, wherein each “o” represents a phosphodiester internucleoside linkage and each “s” represents a phosphorothioate internucleoside linkage.

In any of the oligomeric duplexes described herein, at least one nucleobase of the first modified oligonucleotide and/or the second modified oligonucleotide can be modified nucleobase. In certain embodiments, the modified nucleobase is 5-methylcytosine.

In any of the oligomeric duplexes described herein, the first modified oligonucleotide can comprise a stabilized phosphate group attached to the 5' position of the 5'-most nucleoside. In certain embodiments, the stabilized phosphate group comprises a cyclopropyl phosphonate or an (E)-vinyl phosphonate.

In any of the oligomeric duplexes described herein, the first modified oligonucleotide can comprise a conjugate group. In certain embodiments, the conjugate group comprises a conjugate linker and a conjugate moiety. In certain embodiments, the conjugate group is attached to the first modified oligonucleotide at the 5'-end of the first modified oligonucleotide. In certain embodiments, the conjugate group is attached to the first modified oligonucleotide at the 3'-end of the modified oligonucleotide. In certain embodiments, the conjugate group comprises N-acetyl galactosamine. In certain embodiments, the conjugate group comprises a cell-targeting moiety having an affinity for transferrin receptor (TfR), also known as TfR1 and CD71. In certain embodiments, the conjugate group comprises an anti-TfR1 antibody or fragment thereof. In certain embodiments, the conjugate group comprises a protein or peptide capable of binding TfR1.

In certain embodiments, the conjugate group comprises an aptamer capable of binding TfR1. In certain embodiments, conjugate groups may be selected from any of a C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, C12 alkenyl, C11 alkenyl, C9 alkenyl, C8 alkenyl, C7 alkenyl, C6 alkenyl, or C5 alkenyl. In certain embodiments, conjugate groups may be selected from any of C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, and C5 alkyl, where the alkyl chain has one or more unsaturated bonds.

In any of the oligomeric duplexes described herein, the second modified oligonucleotide can comprise a conjugate group. In certain embodiments, the conjugate group comprises a conjugate linker and a conjugate moiety. In certain embodiments, the conjugate group is attached to the second modified oligonucleotide at the 5'-end of the second modified oligonucleotide. In certain embodiments, the conjugate group is attached to the second modified oligonucleotide at the 3'-end of the modified oligonucleotide. In certain embodiments, the conjugate group comprises N-acetyl galactosamine. In certain embodiments, the conjugate group comprises a cell-targeting moiety having an affinity for transferrin receptor (TfR), also known as TfR1 and CD71. In certain embodiments, the conjugate group comprises an anti-TfR1 antibody or fragment thereof. In certain embodiments, the conjugate group comprises a protein or peptide capable of binding TfR1.

In certain embodiments, the conjugate group comprises an aptamer capable of binding TfR1. In certain embodiments, conjugate groups may be selected from any of a C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, C12 alkenyl, C11 alkenyl, C9 alkenyl, C8 alkenyl, C7 alkenyl, C6 alkenyl, or C5 alkenyl. In certain embodiments, conjugate groups may be selected from any of C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, and C5 alkyl, where the alkyl chain has one or more unsaturated bonds.

In certain embodiments, an antisense agent comprises an antisense compound, which comprises an oligomeric compound or an oligomeric duplex described herein. In certain embodiments, an antisense agent, which can comprise an oligomeric compound or an oligomeric duplex described herein, is an RNAi agent capable of reducing the amount of PLN nucleic acid through the activation of RISC/Ago2.

Certain embodiments provide an oligomeric agent comprising two or more oligomeric duplexes. In certain embodiments, an oligomeric agent comprises two or more of any of the oligomeric duplexes described herein. In certain embodiments, an oligomeric agent comprises two or more of the same oligomeric duplex, which can be any of the oligomeric duplexes described herein. In certain embodiments, the two or more oligomeric duplexes are linked together.

In certain embodiments, the two or more oligomeric duplexes are covalently linked together. In certain embodiments, the second modified oligonucleotides of two or more oligomeric duplexes are covalently linked together. In certain embodiments, the second modified oligonucleotides of two or more oligomeric duplexes are covalently linked together at their 3' ends. In certain embodiments, the two or more oligomeric duplexes are covalently linked together by a glycol linker, such as a tetraethylene glycol linker.

I. Certain Oligonucleotides In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage. Certain modified nucleosides and modified internucleoside linkages suitable for use in modified oligonucleotides are described below.

A. Certain Modified Nucleosides

Modified nucleosides comprise a modified sugar moiety or a modified nucleobase or both a modified sugar moiety and a modified nucleobase. In certain embodiments, modified nucleosides comprising the following modified sugar moieties and/or the following modified nucleobases may be incorporated into modified oligonucleotides.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 3', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-$OCH_3$ ("OMe" or "O-methyl"), and 2'-$O(CH_2)_2OCH_3$ ("MOE" or "O-methoxyethyl"). In certain embodiments, 2'-substituent groups are selected from among: halo, allyl, amino, azido, SH, CN, OCN, $CF_3$, $OCF_3$, O—$C_1$-$C_{10}$ alkoxy, O—$C_1$-$C_{10}$ substituted alkoxy, O—$C_1$-$C_{10}$ alkyl, O—$C_1$-$C_{10}$ substituted alkyl, S-alkyl, N($R_m$)-alkyl, O-alkenyl, S-alkenyl, N($R_m$)-alkenyl, O-alkynyl, S-alkynyl, N($R_m$)-alkynyl, O-alkylenyl-O-alkyl, alkynyl, alkaryl, aralkyl, O-alkaryl, O-aralkyl, $O(CH_2)_2SCH_3$, $O(CH_2)_2ON(R_m)(R_n)$ or $OCH_2C(=O)$—N($R_m$)($R_n$), where each $R_m$ and $R_n$ is, independently, H, an amino protecting group, or substituted or unsubstituted C1-C10 alkyl, —O(CH2)2ON(CH3)2 ("DMAOE"), 2'-OCH2OCH2N(CH2)2 ("DMAEOE"), and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro ($NO_2$), thiol, thioalkoxy, thioalkyl, halogen, alkyl, aryl, alkenyl and alkynyl. In certain embodiments, non-bicyclic modified sugar moieties comprise a substituent group at the 3'-position. Examples of substituent groups suitable for the 3'-position of modified sugar moieties include but are not limited to alkoxy (e.g., methoxy), alkyl (e.g., methyl, ethyl). In certain embodiments, non-bicyclic modified sugar moieties comprise a substituent group at the 4'-position. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5'-methyl (R or S), 5'-vinyl, ethyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836).

In certain embodiments, a 2'-substituted non-bicyclic modified nucleoside comprises a sugar moiety comprising a non-bridging 2'-substituent group selected from: F, $NH_2$, $N_3$, $OCF_3$, $OCH_3$, $O(CH_2)_3NH_2$, $CH_2CH{=}CH_2$, $OCH_2CH{=}CH_2$, $OCH_2CH_2OCH_3$, $O(CH_2)_2SCH_3$, $O(CH_2)_2ON(R_m)(R_n)$, $O(CH_2)_2O(CH_2)_2N(CH_3)_2$, and N-substituted acetamide ($OCH_2C({=}O){-}N(R_m)(R_n)$), where each $R_m$ and $R_n$ is, independently, H, an amino protecting group, or substituted or unsubstituted $C_1$-$C_{10}$ alkyl.

In certain embodiments, a 2'-substituted nucleoside non-bicyclic modified nucleoside comprises a sugar moiety comprising a non-bridging 2'-substituent group selected from: F, $OCF_3$, $OCH_3$, $OCH_2CH_2OCH_3$, $O(CH_2)_2SCH_3$, $O(CH_2)_2ON(CH_3)_2$, $O(CH_2)_2O(CH_2)_2N(CH_3)_2$, $O(CH_2)_2ON(CH_3)_2$ ("DMAOE"), $OCH_2OCH_2N(CH_2)_2$ ("DMAEOE") and $OCH_2C({=}O){-}N(H)CH_3$ ("NMA").

In certain embodiments, a 2'-substituted non-bicyclic modified nucleoside comprises a sugar moiety comprising a non-bridging 2'-substituent group selected from: F, $OCH_3$, and $OCH_2CH_2OCH_3$.

In certain embodiments, modified furanosyl sugar moieties and nucleosides incorporating such modified furanosyl sugar moieties are further defined by isomeric configuration. For example, a 2'-deoxyfuranosyl sugar moiety may be in seven isomeric configurations other than the naturally occurring β-D-deoxyribosyl configuration. Such modified sugar moieties are described in, e.g., WO 2019/157531, incorporated by reference herein. A 2'-modified sugar moiety has an additional stereocenter at the 2'-position relative to a 2'-deoxyfuranosyl sugar moiety; therefore, such sugar moieties have a total of sixteen possible isomeric configurations. 2'-modified sugar moieties described herein are in the β-D-ribosyl isomeric configuration unless otherwise specified.

In naturally occurring nucleic acids, sugars are linked to one another 3' to 5'. In certain embodiments, oligonucleotides include one or more nucleoside or sugar moiety linked at an alternative position, for example at the 2' or inverted 5' to 3'. For example, where the linkage is at the 2' position, the 2'-substituent groups may instead be at the 3'-position.

Certain modified sugar moieties comprise a substituent that bridges two atoms of the furanosyl ring to form a second ring, resulting in a bicyclic sugar moiety. Nucleosides comprising such bicyclic sugar moieties have been referred to as bicyclic nucleosides (BNAs), locked nucleosides, or conformationally restricted nucleotides (CRN). Certain such compounds are described in US Patent Publication No. 2013/0190383; and PCT publication WO 2013/036868. In certain such embodiments, the bicyclic sugar moiety comprises abridge between the 4' and the 2' furanose ring atoms. In certain such embodiments, the furanose ring is a ribose ring. Examples of such 4' to 2' bridging sugar substituents include but are not limited to: 4'-$CH_2$-2', 4'-$(CH_2)_2$-2', 4'-$(CH_2)_3$-2', 4'-$CH_2$—O-2' ("LNA"), 4'-$CH_2$—S-2', 4'-$(CH_2)_2$—O-2' ("ENA"), 4'-$CH(CH_3)$—O-2' (referred to as "constrained ethyl" or "cEt" when in the S configuration), 4'-$CH_2$—O—$CH_2$-2', 4'-$CH_2$—N(R)-2', 4'-CH($CH_2OCH_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-$C(CH_3)(CH_3)$—O-2' and analogs thereof (see, e.g., Seth et al., U.S. Pat. No. 8,278,283), 4'-$CH_2$—$N(OCH_3)$-2' and analogs thereof (see, e.g., Prakash et al., U.S. Pat. No. 8,278,425), 4'-$CH_2$—O—$N(CH_3)$-2' (see, e.g., Allerson et al., U.S. Pat. No. 7,696,345 and Allerson et al., U.S. Pat. No. 8,124,745), 4'-$CH_2$—C(H)($CH_3$)-2' (see, e.g., Zhou, et al., *J. Org. Chem.,* 2009, 74, 118-134), 4'-$CH_2$—C(=$CH_2$)-2' and analogs thereof (see e.g., Seth et al., U.S. Pat. No. 8,278,426), 4'-$C(R_aR_b)$—N(R)—O-2', 4'-$C(R_aR_b)$—O—N(R)-2', 4'-$CH_2$—O—N(R)-2', and 4'-$CH_2$—N(R)—O-2', wherein each R, $R_a$, and $R_b$ is, independently, H, a protecting group, or $C_1$-$C_{12}$ alkyl (see, e.g. Imanishi et al., U.S. Pat. No. 7,427,672).

In certain embodiments, such 4' to 2' bridges independently comprise from 1 to 4 linked groups independently selected from: —[C(Ra)(Rb)]n-, —[C(Ra)(Rb)]n-O—, C(Ra)=C(Rb)—, C(Ra)=N—, C(=NRa)—, —C(=O)—, —C(=S)—, —O—, —Si(Ra)2-, —S(=O)x-, and N(Ra)—;

wherein:

x is 0, 1, or 2;

n is 1, 2, 3, or 4;

each Ra and $R_b$ is, independently, H, a protecting group, hydroxyl, C1-C12 alkyl, substituted C1-C12 alkyl, C2-C12 alkenyl, substituted C2-C12 alkenyl, C2-C12 alkynyl, substituted C2-C12 alkynyl, C5-C20 aryl, substituted C5-C20 aryl, heterocycle radical, substituted heterocycle radical, heteroaryl, substituted heteroaryl, C5-C7 alicyclic radical, substituted C5-C7 alicyclic radical, halogen, OJ1, NJ1J2, SJ1, N3, COOJ1, acyl (C(=O)—H), substituted acyl, CN, sulfonyl (S(=O) 2-J1), or sulfoxyl (S(=O)-J1); and each J1 and J2 is, independently, H, C1-C12 alkyl, substituted C1-C12 alkyl, C2-C12 alkenyl, substituted C2-C12 alkenyl, C2-C12 alkynyl, substituted C2-C12 alkynyl, C5-C20 aryl, substituted C5-C20 aryl, acyl (C(=O)—H), substituted acyl, a heterocycle radical, a substituted heterocycle radical, C1-C12 aminoalkyl, substituted C1-C12 aminoalkyl, or a protecting group.

Additional bicyclic sugar moieties are known in the art, see, for example: Freier et al., Nucleic Acids Research, 1997, 25(22), 4429-4443, Albaek et al., J. Org. Chem., 2006, 71, 7731-7740, Singh et al., Chem. Commun., 1998, 4, 455-456; Koshkin et al., Tetrahedron, 1998, 54, 3607-3630; Wahlestedt et al., Proc. Natl. Acad. Sci. U.S.A., 2000, 97, 5633-5638; Kumar et al., Bioorg. Med. Chem. Lett., 1998, 8, 2219-2222; Singh et al., J. Org. Chem., 1998, 63, 10035-10039; Srivastava et al., J. Am. Chem. Soc., 2007, 129, 8362-8379; Elayadi et al., Curr. Opinion Invens. Drugs, 2001, 2, 558-561; Braasch et al., Chem. Biol., 2001, 8, 1-7; Orum et al., Curr. Opinion Mol. Ther., 2001, 3, 239-243; Wengel et al., U.S. Pat. No. 7,053,207, Imanishi et al., U.S. Pat. No. 6,268,490, Imanishi et al. U.S. Pat. No. 6,770,748, Imanishi et al., U.S. RE44,779; Wengel et al., U.S. Pat. No. 6,794,499, Wengel et al., U.S. Pat. No. 6,670,461; Wengel et al., U.S. Pat. No. 7,034,133, Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191, Torsten et al., WO 2004/106356, Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; Allerson et al., US2008/0039618; and Migawa et al., US2015/0191727. In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

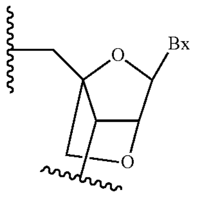

LNA (β-D-configuration)
bridge = 4'-$CH_2$-O-2'

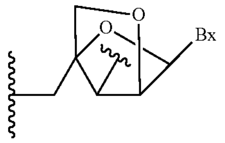

α-L-LNA (α-L-configuration)
bridge = 4'-$CH_2$-O-2'

α-L-methyleneoxy (4'-$CH_2$—O-2') or α-L-LNA bicyclic nucleosides have been incorporated into oligonucleotides that showed antisense activity (Frieden et al., Nucleic Acids Research, 2003, 21, 6365-6372). The addition of locked nucleic acids to siRNAs has been shown to increase siRNA stability in serum, and to reduce off-target effects (Elmen, J. et al., (2005) Nucleic Acids Research 33(1):439-447; Mook, O R. et al., (2007) Mal Cane Ther 6(3):833-843; Grunweller, A. et al., (2003) Nucleic Acids Research 31(12):3185-3193). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, C J. *Bioorg. & Med. Chem.* 2002, 10, 841-854), fluoro HNA:

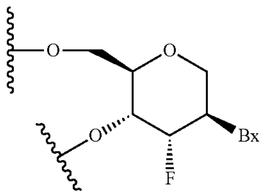

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

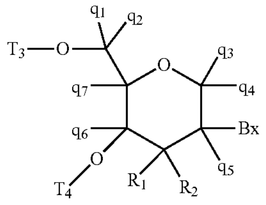

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, $OC(=X)J_1$, $OC(=X)NJ_1J_2$, $NJ_3C(=X)NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and q are each H. In certain embodiments, at least one of $q_1$, $q_2$, $q_3$, $q_4$, $q_5$, $q_6$ and q is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685;

Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

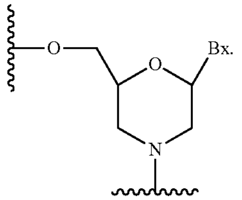

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., *Org. Biomol. Chem.,* 2013, 11, 5853-5865), and nucleosides and oligonucleotides described in Manoharan et al., WO2011/133876. In certain embodiments, sugar surrogates comprise acyclic moieties. Examples of nucleosides and oligonucleotides comprising such acyclic sugar surrogates include, but are not limited to: peptide nucleic acid ("PNA"), acyclic butyl nucleic acid (see, e.g., Kumar et al., *Org. Biomol. Chem.,* 2013, 11, 5853-5865), and nucleosides and oligonucleotides described in Manoharan et al., US2013/130378. Representative U.S. patents that teach the preparation of PNA compounds include, but are not limited to, U.S. Pat. Nos. 5,539,082; 5,714,331; and 5,719,262. Additional PNA compounds suitable for use in the oligonucleotides of the invention are described in, for example, in Nielsen et al., *Science,* 1991, 254, 1497-1500.

In certain embodiments, sugar surrogates are the "unlocked" sugar structure of UNA (unlocked nucleic acid) nucleosides. UNA is an unlocked acyclic nucleic acid, wherein any of the bonds of the sugar has been removed, forming an unlocked sugar surrogate. Representative U.S. publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

In certain embodiments, sugar surrogates are the glycerol as found in GNA (glycol nucleic acid) nucleosides as depicted below:

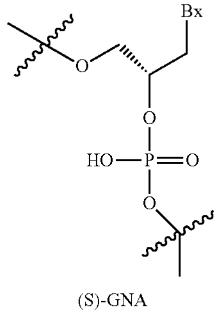

(S)-GNA where Bx represents any nucleobase.

Many other bicyclic and tricyclic sugar and sugar surrogates are known in the art that can be used in modified nucleosides.

2. Certain Modified Nucleobases

In certain embodiments, modified oligonucleotides comprise one or more nucleosides comprising an unmodified nucleobase. In certain embodiments, modified oligonucleotides comprise one or more nucleosides comprising a modified nucleobase. In certain embodiments, modified oligonucleotides comprise one or more nucleosides that does not comprise a nucleobase, referred to as an abasic nucleoside. In certain embodiments, modified oligonucleotides comprise one or more inosine nucleosides (i.e., nucleosides comprising a hypoxanthine nucleobase).

In certain embodiments, modified nucleobases are selected from: 5-substituted pyrimidines, 6-azapyrimidines, alkyl or alkynyl substituted pyrimidines, alkyl substituted purines, and N-2, N-6 and 0-6 substituted purines. In certain embodiments, modified nucleobases are selected from: 5-methylcytosine, 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl ($-C{\equiv}C-CH_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in The Concise Encyclopedia Of Polymer Science And Engineering, Kroschwitz, J. I., Ed., John Wiley & Sons, 1990, 858-859; Englisch et al., Angewandte Chemie, International Edition, 1991, 30, 613; Sanghvi, Y. S., Chapter 15, Antisense Research and Applications, Crooke, S. T. and Lebleu, B., Eds., CRC Press, 1993, 273-288; and those disclosed in Chapters 6 and 15, Antisense Drug Technology, Crooke S. T., Ed., CRC Press, 2008, 163-166 and 442-443.

Publications that teach the preparation of certain of the above noted modified nucleobases as well as other modified nucleobases include without limitation, Manoharan et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., U.S. Pat. No. 6,166,199; and Matteucci et al., U.S. Pat. No. 6,005,096.

3. Certain Modified Internucleoside Linkages

The naturally occurring internucleoside linkage of RNA and DNA is a 3' to 5' phosphodiester linkage. In certain embodiments, nucleosides of modified oligonucleotides may be linked together using one or more modified internucleoside linkages. The two main classes of internucleoside linking groups are defined by the presence or absence of a phosphorus atom. Representative phosphorus-containing internucleoside linkages include but are not limited to phosphates, which contain aphosphodiester bond ("P═O") (also referred to as unmodified or naturally occurring linkages), phosphotriesters, methylphosphonates, phosphoramidates, and phosphorothioates ("P═S"), and phosphorodithioates ("HS—P═S"). Representative non-phosphorus containing internucleoside linking groups include but are not limited to methylenemethylimino ($—CH_2—N(CH_3)—O—CH_2—$), thiodiester, thionocarbamate ($—O—C(═O)(NH)—S—$); siloxane ($—O—SiH_2—O—$); and N,N'-dimethylhydrazine ($—CH_2—N(CH_3)—N(CH_3)—$). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

In certain embodiments, a modified internucleoside linkage is any of those described in WO/2021/030778, incorporated by reference herein. In certain embodiments, a modified internucleoside linkage comprises the formula:

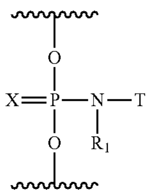

wherein independently for each internucleoside linking group of the modified oligonucleotide:

X is selected from O or S;

$R_1$ is selected from H, $C_1$-$C_6$ alkyl, and substituted $C_1$-$C_6$ alkyl; and T is selected from $SO_2R_2$, $C(═O)R_3$, and $P(═O)R_4R_5$, wherein:

$R_2$ is selected from an aryl, a substituted aryl, a heterocycle, a substituted heterocycle, an aromatic heterocycle, a substituted aromatic heterocycle, a diazole, a substituted diazole, a $C_1$-$C_6$ alkoxy, $C_1$-$C_6$ alkyl, $C_1$-$C_6$ alkenyl, $C_1$-$C_6$ alkynyl, substituted $C_1$-$C_6$ alkyl, substituted $C_1$-$C_6$ alkenyl substituted $C_1$-$C_6$ alkynyl, and a conjugate group;

$R_3$ is selected from an aryl, a substituted aryl, $CH_3$, $N(CH_3)_2$, $OCH_3$ and a conjugate group;

$R_4$ is selected from $OCH_3$, OH, $C_1$-$C_6$ alkyl, substituted $C_1$-$C_6$ alkyl and a conjugate group; and $R_5$ is selected from $OCH_3$, OH, $C_1$-$C_6$ alkyl, and substituted $C_1$-$C_6$ alkyl.

In certain embodiments, a modified internucleoside linkage comprises a mesyl phosphoramidate linking group having a formula:

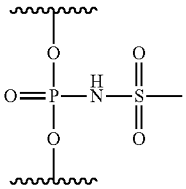

In certain embodiments, a mesyl phosphoramidate internucleoside linkage may comprise a chiral center. In certain embodiments, modified oligonucleotides comprising (Rp) and/or (Sp) mesyl phosphoramidates comprise one or more of the following formulas, respectively, wherein "B" indicates a nucleobase:

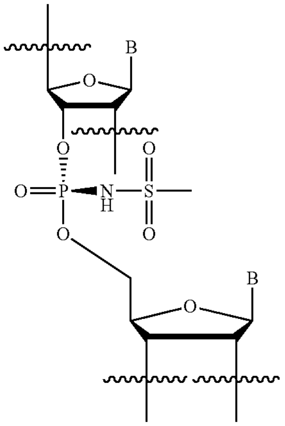

($S_p$)

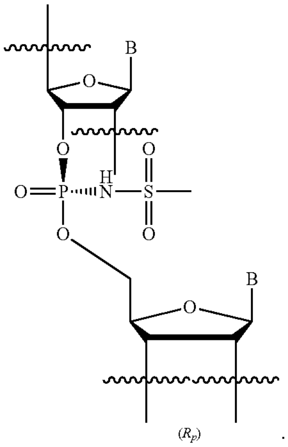

($R_p$)

.

Representative internucleoside linkages having a chiral center include but are not limited to phosphoramidates, alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate or phosphoramidate linkages in particular stereochemical configurations. In certain embodiments, populations of modified oligonucleotides comprise phosphorothioate internucleoside linkages wherein all of the phosphorothioate internucleoside linkages are stereorandom. In certain embodiments, populations of modified oligonucleotides comprise mesyl phosphoramidate internucleoside linkages wherein all of the mesyl phosphoramidate internucleoside linkages are stereorandom. In certain embodiments, populations of modified oligonucleotides comprise phosphorothioate and mesyl phosphoramidate internucleoside linkages wherein all of the phosphorothioate and mesyl phosphoramidate internucleoside linkages are stereorandom. Such modified oligonucleotides can be generated using synthetic methods that result in random selection of the stereochemical configuration of each phosphorothioate linkage. Nonetheless, each individual phosphorothioate and each phosphoramidate of each individual oligonucleotide molecule has a defined stereoconfiguration.

In certain embodiments, populations of modified oligonucleotides are enriched for modified oligonucleotides comprising one or more particular phosphorothioate or phosphoramidate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. In certain embodiments, the particular configuration of the particular mesyl phosphoramidate linkage is present in at least 65% of the molecules in the population. In certain embodiments, the particular configuration of the particular mesyl phosphoramidate linkage is present in at least 70% of the molecules in the population. In certain embodiments, the particular configuration of the particular mesyl phosphoramidate linkage is present in at least 80% of the molecules in the population. In certain embodiments, the particular configuration of the particular mesyl phosphoramidate linkage is present in at least 90% of the molecules in the population. In certain embodiments, the particular configuration of the particular mesyl phosphoramidate linkage is present in at least 99% of the molecules in the population.

Such chirally enriched populations of modified oligonucleotides can be generated using synthetic methods known in the art, e.g., methods described in Oka et al., *JACS* 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

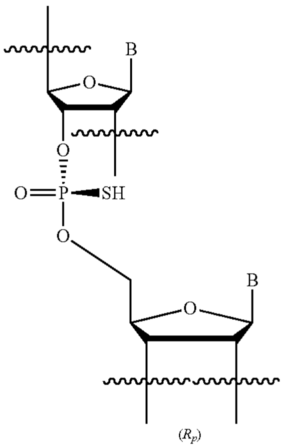

($R_p$)

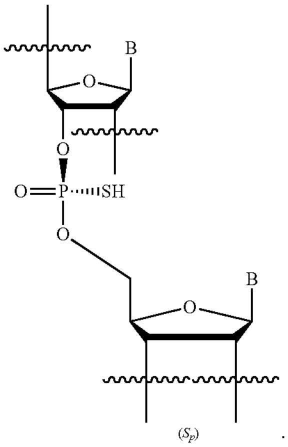

($S_p$) .

In certain embodiments, a population of modified oligonucleotides is enriched for modified oligonucleotides having at least one indicated phosphoramidate in the (Sp) configuration. In certain embodiments, a population of modified oligonucleotides is enriched for modified oligonucleotides having at least one phosphoramidate in the (Rp) configuration. Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-$CH_2$—$N(CH_3)$—O-5'), amide-3 (3'-$CH_2$—C(═O)—N(H)-5'), amide-4 (3'-$CH_2$—N(H)—C(═O)-5'), formacetal (3'-O—$CH_2$—O-5'), methoxypropyl (MOP), and thioformacetal (3'-S—$CH_2$—O-5'). Further neutral internucleoside linkages include nonionic linkages comprising siloxane (dialkylsiloxane), carboxylate ester, carboxamide, sulfide, sulfonate ester and amides (See for example: *Car-*

*bohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and $CH_2$ component parts.

In certain embodiments, modified oligonucleotides comprise one or more inverted nucleoside, as shown below:

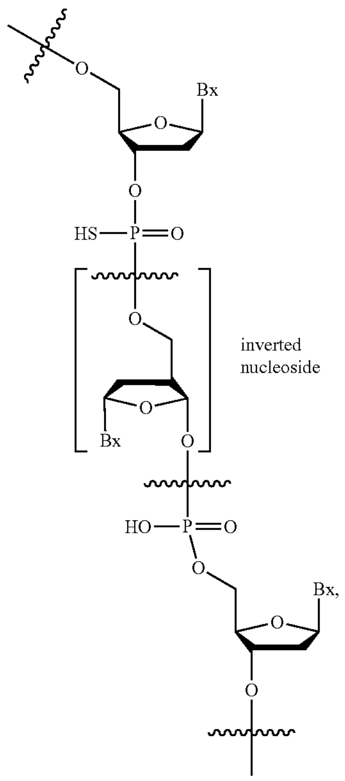

wherein each Bx independently represents any nucleobase.

In certain embodiments, an inverted nucleoside is terminal (i.e., the last nucleoside on one end of an oligonucleotide) and so only one internucleoside linkage depicted above will be present. In certain such embodiments, additional features (such as a conjugate group) may be attached to the inverted nucleoside. Such terminal inverted nucleosides can be attached to either or both ends of an oligonucleotide.

In certain embodiments, such groups lack a nucleobase and are referred to herein as inverted sugar moieties. In certain embodiments, an inverted sugar moiety is terminal (i.e., attached to the last nucleoside on one end of an oligonucleotide) and so only one internucleoside linkage above will be present. In certain such embodiments, additional features (such as a conjugate group) may be attached to the inverted sugar moiety. Such terminal inverted sugar moieties can be attached to either or both ends of an oligonucleotide.

In certain embodiments, nucleic acids can be linked 2' to 5' rather than the standard 3' to 5' linkage. Such a linkage is illustrated below.

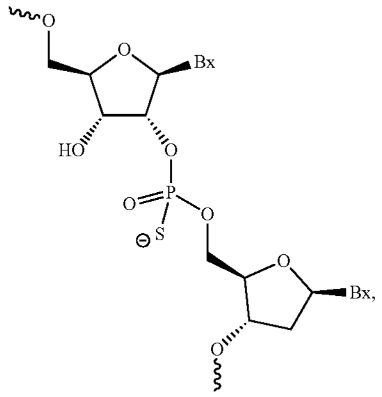

wherein each Bx represents any nucleobase.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

Gapmer Oligonucleotides

In certain embodiments, modified oligonucleotides comprise or consist of a region having a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-6 nucleosides. In certain embodiments, each nucleoside of each wing of a gapmer comprises a modified sugar moiety. In certain embodiments, at least one nucleoside of each wing of a gapmer comprises a modified sugar moiety. In certain embodiments, at least two nucleosides of each wing of a gapmer comprises a modified sugar moiety. In certain embodiments, at least three nucleosides of each wing of a gapmer comprises a modified sugar moiety. In certain embodiments, at least four nucleosides of each wing of a gapmer comprises a modified sugar moiety.

In certain embodiments, the gap of a gapmer comprises 7-12 nucleosides. In certain embodiments, each nucleoside of the gap of a gapmer comprises a 2'-β-D-deoxyribosyl sugar moiety. In certain embodiments, at least one nucleoside of the gap of a gapmer comprises a modified sugar moiety.

In certain embodiments, the gapmer is a deoxy gapmer. In certain embodiments, the nucleosides on the gap side of each wing/gap junction comprise 2'-deoxyribosyl sugar moieties and the nucleosides on the wing sides of each wing/gap junction comprise modified sugar moieties. In certain embodiments, each nucleoside of the gap comprises a 2'-β-D-deoxyribosyl sugar moiety. In certain embodiments, each nucleoside of each wing of a gapmer comprises a modified sugar moiety. In certain embodiments, at least one nucleoside of the gap of a gapmer comprises a modified sugar moiety.

In certain embodiments, one nucleoside of the gap comprises a modified sugar moiety and each remaining nucleoside of the gap comprises a 2'-deoxyribosyl sugar moiety. In certain embodiments, at least one nucleoside of the gap of a gapmer comprises a 2'-OMe sugar moiety.

Herein, the lengths (number of nucleosides) of the three regions of a gapmer may be provided using the notation [#of nucleosides in the 5'-wing]-[#of nucleosides in the gap]-[#of nucleosides in the 3'-wing]. Thus, a 3-10-3 gapmer consists of 3 linked nucleosides in each wing and 10 linked nucleosides in the gap. Where such nomenclature is followed by a specific modification, that modification is the modification in each sugar moiety of each wing and the gap nucleosides comprise 2'-β-D-deoxyribosyl sugar moieties. A 3-10-3 cEt gapmer consists of 3 linked cEt nucleosides in the 5'-wing, 10 linked 2'-β-D-deoxynucleosides in the gap, and 3 linked cEt nucleosides in the 3'-wing.

In certain embodiments, modified oligonucleotides have the sugar motif from 5' to 3': ekddddddddkekek; wherein each "d" represents a 2'-β-D-deoxyribosyl sugar moiety, each "e" represents a 2'-MOE sugar moiety, and each "k" represents a cEt modified sugar moiety.

In certain embodiments, modified oligonucleotides have the sugar motif from 5' to 3': ekkddddddddddkkk; wherein each "d" represents a 2'-β-D-deoxyribosyl sugar moiety, each "e" represents a 2'-MOE sugar moiety, and each "k" represents a cEt modified sugar moiety.

In certain embodiments, modified oligonucleotides have the sugar motif from 5' to 3': ekkdddddddddkkke; wherein each "d" represents a 2'-β-D-deoxyribosyl sugar moiety, each "e" represents a 2'-MOE sugar moiety, and each "k" represents a cEt modified sugar moiety.

In certain embodiments, modified oligonucleotides have the sugar motif from 5' to 3': keddddddddkekek; wherein each "d" represents a 2'-β-D-deoxyribosyl sugar moiety, each "e" represents a 2'-MOE sugar moiety, and each "k" represents a cEt modified sugar moiety.

In certain embodiments, modified oligonucleotides have the sugar motif from 5' to 3': kekddddddddddkkk; wherein each "d" represents a 2'-β-D-deoxyribosyl sugar moiety, each "e" represents a 2'-MOE sugar moiety, and each "k" represents a cEt modified sugar moiety.

In certain embodiments, modified oligonucleotides have the sugar motif from 5' to 3': kkedddddddddkkk; wherein each "d" represents a 2'-β-D-deoxyribosyl sugar moiety, each "e" represents a 2'-MOE sugar moiety, and each "k" represents a cEt modified sugar moiety.

In certain embodiments, modified oligonucleotides have the sugar motif from 5' to 3': kkeddddddddddkkke; wherein each "d" represents a 2'-β-D-deoxyribosyl sugar moiety, each "e" represents a 2'-MOE sugar moiety, and each "k" represents a cEt modified sugar moiety.

In certain embodiments, modified oligonucleotides have the sugar motif from 5' to 3: kkkdddddddddkkke; wherein each "d" represents a 2'-β-D-deoxyribosyl sugar moiety, each "e" represents a 2'-MOE sugar moiety, and each "k" represents a cEt modified sugar moiety.

In certain embodiments, modified oligonucleotides have the sugar motif from 5' to 3': kkkdyddddddddkkk; wherein each "d" represents a 2'-β-D-deoxyribosyl sugar moiety, each "y" represents a 2'-OMe sugar moiety, and each "k" represents a cEt modified sugar moiety.

In certain embodiments, modified oligonucleotides have the sugar motif from 5' to 3': kkddddddddddkk; wherein each "d" represents a 2'-β-D-deoxyribosyl sugar moiety, and each "k" represents a cEt modified sugar moiety.

In certain embodiments, modified oligonucleotides have the sugar motif from 5' to 3': kkkddddddddddkeee; wherein each "d" represents a 2'-β-D-deoxyribosyl sugar moiety, each "e" represents a 2'-MOE sugar moiety, and each "k" represents a cEt modified sugar moiety.

In certain embodiments, modified oligonucleotides have the sugar motif from 5' to 3': kkkddddddddddkkee; wherein each "d" represents a 2'-β-D-deoxyribosyl sugar moiety, each "e" represents a 2'-MOE sugar moiety, and each "k" represents a cEt modified sugar moiety.

In certain embodiments, modified oligonucleotides have the sugar motif from 5' to 3': kkkddddddddddkkkk; wherein each "d" represents a 2'-β-D-deoxyribosyl sugar moiety, and each "k" represents a cEt modified sugar moiety.

In certain embodiments, modified oligonucleotides have the sugar motif from 5' to 3': kkkkddddddddddkkk; wherein each "d" represents a 2'-β-D-deoxyribosyl sugar moiety, and each "k" represents a cEt modified sugar moiety.

In certain embodiments, modified oligonucleotides have the sugar motif from 5' to 3': kkkddddddddddkeeee; wherein each "d" represents a 2'-β-D-deoxyribosyl sugar moiety, each "e" represents a 2'-MOE sugar moiety, and each "k" represents a cEt modified sugar moiety.

In certain embodiments, modified oligonucleotides have the sugar motif from 5' to 3': kkkddddddddddkkeee; wherein each "d" represents a 2'-β-D-deoxyribosyl sugar moiety, each "e" represents a 2'-MOE sugar moiety, and each "k" represents a cEt modified sugar moiety.

In certain embodiments, modified oligonucleotides have the sugar motif from 5' to 3': kkkkddddddddddkkkk; wherein each "d" represents a 2'-β-D-deoxyribosyl sugar moiety, and each "k" represents a cEt modified sugar moiety.

In certain embodiments, modified oligonucleotides have the sugar motif from 5' to 3': kkkkkddddddddddkkkkk; wherein each "d" represents a 2'-β-D-deoxyribosyl sugar moiety, and each "k" represents a cEt modified sugar moiety.

In certain embodiments, modified oligonucleotides have the sugar motif from 5' to 3': kkddddddddkekek; wherein each "d" represents a 2'-β-D-deoxyribosyl sugar moiety, each "e" represents a 2'-MOE sugar moiety, and each "k" represents a cEt modified sugar moiety.

Certain Target-Independent Sugar Motifs

Certain sugar motifs provided herein are useful for modified oligonucleotides generally regardless of nucleobase sequence. The nucleobase sequence of the modified oligonucleotide can be complementary to any target. In certain embodiments, oligomeric compounds comprise modified oligonucleotides that are gapmers.

In certain embodiments, an oligomeric compound comprises a modified oligonucleotide having the sugar motif from 5' to 3': ekkddddddddkekek; wherein each "d" represents a 2'-β-D-deoxyribosyl sugar moiety, each "e" represents a 2'-MOE sugar moiety, and each "k" represents a cEt modified sugar moiety. In certain embodiments, the modified oligonucleotide has a nucleobase sequence complementary to a target RNA.

In certain embodiments, an oligomeric compound comprises a modified oligonucleotide having the sugar motif from 5' to 3': ekkddddddddddkkk; wherein each "d" represents a 2'-β-D-deoxyribosyl sugar moiety, each "e" represents a 2'-MOE sugar moiety, and each "k" represents a cEt modified sugar moiety. In certain embodiments, the modified oligonucleotide has a nucleobase sequence complementary to a target RNA.

In certain embodiments, an oligomeric compound comprises a modified oligonucleotide having the sugar motif from 5' to 3': ekkddddddddddkkke; wherein each "d" represents a 2'-β-D-deoxyribosyl sugar moiety, each "e" represents a 2'-MOE sugar moiety, and each "k" represents a cEt modified sugar moiety. In certain embodiments, the modified oligonucleotide has a nucleobase sequence complementary to a target RNA.

In certain embodiments, an oligomeric compound comprises a modified oligonucleotide having the sugar motif from 5' to 3': keddddddddddkekek; wherein each "d" represents a 2'-β-D-deoxyribosyl sugar moiety, each "e" represents a 2'-MOE sugar moiety, and each "k" represents a cEt modified sugar moiety. In certain embodiments, the modified oligonucleotide has a nucleobase sequence complementary to a target RNA.

In certain embodiments, an oligomeric compound comprises a modified oligonucleotide having the sugar motif from 5' to 3': kekddddddddddkkk; wherein each "d" represents a 2'-β-D-deoxyribosyl sugar moiety, each "e" represents a 2'-MOE sugar moiety, and each "k" represents a cEt modified sugar moiety. In certain embodiments, the modified oligonucleotide has a nucleobase sequence complementary to a target RNA.

In certain embodiments, an oligomeric compound comprises a modified oligonucleotide having the sugar motif from 5' to 3': kkeddddddddddkkk; wherein each "d" represents a 2'-β-D-deoxyribosyl sugar moiety, each "e" represents a 2'-MOE sugar moiety, and each "k" represents a cEt modified sugar moiety. In certain embodiments, the modified oligonucleotide has a nucleobase sequence complementary to a target RNA.

In certain embodiments, an oligomeric compound comprises a modified oligonucleotide having the sugar motif from 5' to 3': kkeddddddddddkkke; wherein each "d" represents a 2'-β-D-deoxyribosyl sugar moiety, each "e" represents a 2'-MOE sugar moiety, and each "k" represents a cEt modified sugar moiety. In certain embodiments, the modified oligonucleotide has a nucleobase sequence complementary to a target RNA.

In certain embodiments, an oligomeric compound comprises a modified oligonucleotide having the sugar motif from 5' to 3': kkddddddddddkekek; wherein each "d" represents a 2'-β-D-deoxyribosyl sugar moiety, each "e" represents a 2'-MOE sugar moiety, and each "k" represents a cEt modified sugar moiety. In certain embodiments, the modified oligonucleotide has a nucleobase sequence complementary to a target RNA.

2. Certain Nucleobase Motifs

In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl sugar moiety. In certain embodiments, the modified nucleobase is selected from: a 2-thiopyrimidine and a 5-propynepyrimidine.

3. Certain Internucleoside Linkage Motifs

In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P═O). In certain embodiments, each internucleoside linking group of a modified oligonucleotide is a phosphorothioate internucleoside linkage (P═S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate a (Sp) phosphorothioate, and a (Rp) phosphorothioate.

In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain embodiments, the sugar motif of a modified oligonucleotide is a gapmer, the internucleoside linkage motif comprises one, two, or three phosphodiester internucleoside linkages, and the remaining internucleoside linkages are phosphorothioate internucleoside linkages. In certain embodiments, the sugar motif of a modified oligonucleotide is a gapmer, the internucleoside linkage motif comprises three phosphodiester internucleoside linkages, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target RNA in an oocyte injection model. Oligonucleotides 25 nucleobases in length with 8 or 11 mismatch bases near the ends of the oligonucleotides were able to direct specific cleavage of the target RNA, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides.

D. Certain Modified Oligonucleotides

In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a region of an oligonucleotide has a nucleobase sequence that is complementary to a second oligonucleotide or an identified reference nucleic acid, such as a target nucleic acid. In certain embodiments, the nucleobase sequence of a region or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance.

In certain embodiments, conjugation of one or more carbohydrate moieties to a modified oligonucleotide can optimize one or more properties of the modified oligonucleotide. In certain embodiments, the carbohydrate moiety is attached to a modified subunit of the modified oligonucleotide. For example, the ribose sugar of one or more ribonucleotide subunits of a modified oligonucleotide can be replaced with another moiety, e.g. a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS), which is a modified sugar moiety. A cyclic carrier may be a carbocyclic ring system, i.e., one or more ring atoms may be a heteroatom, e.g., nitrogen, oxygen, sulphur. The cyclic carrier may be a monocyclic ring system, or may contain two or more rings, e.g. fused rings. The cyclic carrier may be a fully saturated ring system, or it may contain one or more double bonds. In certain embodiments, the modified oligonucleotide is a gapmer.

In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.,* 1994, 4, 1053-1060), a thioether, e.g., hexyl-S-tritylthiol (Manoharan et al., *Ann. N.Y. Acad. Sci.,* 1992, 660, 306-309; Manoharan et al., *Bioorg. Med. Chem. Lett.,* 1993, 3, 2765-2770), a thiocholesterol (Oberhauser et al., *Nucl. Acids Res.,* 1992, 20, 533-538), an aliphatic chain, e.g., do-decan-diol or undecyl residues (Saison-Behmoaras et al., *EMBO J.,* 1991, 10, 1111-1118; Kabanov et al., *FEBS Lett.,* 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.,* 1995, 36, 3651-3654; Shea et al., *Nucl. Acids Res.,* 1990, 18, 3777-3783), a polyamine or a polyethylene glycol chain (Manoharan et al., *Nucleosides & Nucleotides,* 1995, 14, 969-973), or adamantane acetic acid a palmityl moiety (Mishra et al., *Biochim. Biophys. Acta,* 1995, 1264, 229-237), an octadecylamine or hexylamino-carbonyl-oxycholesterol moiety (Crooke et al., *J. Pharmacol. Exp. Ther.,* 1996, 277, 923-937), a tocopherol group (Nishina et al., *Molecular Therapy Nucleic Acids,* 2015, 4, e220; and Nishina et al., *Molecular Therapy,* 2008, 16, 734-740), or a GalNAc cluster (e.g., WO2014/179620).

In certain embodiments, conjugate groups may be selected from any of a C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, C12 alkenyl, C11 alkenyl, C9 alkenyl, C8 alkenyl, C7 alkenyl, C6 alkenyl, or C5 alkenyl.

In certain embodiments, conjugate groups may be selected from any of C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, and C5 alkyl, where the alkyl chain has one or more unsaturated bonds.

In certain embodiments, a conjugate group has the following structure:

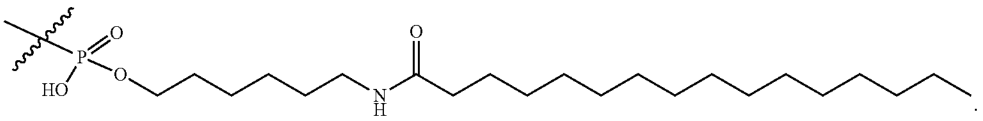

1. Conjugate Moieties

Conjugate moieties include, without limitation, intercalators, reporter molecules, polyamines, polyamides, peptides, carbohydrates (e.g., GalNAc), vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises pyrrolidine.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to compounds, such as the oligonucleotides provided herein. In general, a bifunctional linking moiety comprises at least two functional groups. One of the functional groups is selected to bind to a particular site on a compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides.

In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds.

In certain embodiments, a cleavable moiety is 2'-deoxynucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

3. Cell-Targeting Moieties

In certain embodiments, a conjugate group comprises a cell-targeting moiety. In certain embodiments, a conjugate group has the general formula:

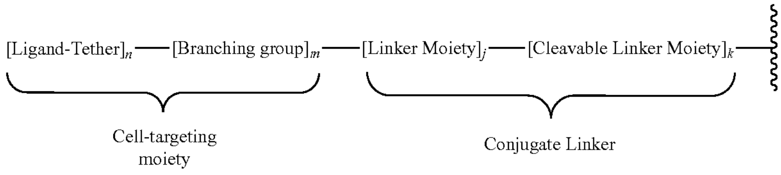

wherein n is from 1 to about 3, m is 0 when n is 1, m is 1 when n is 2 or greater, j is 1 or 0, and k is 1 or 0.

In certain embodiments, n is 1, j is 1 and k is 0. In certain embodiments, n is 1, j is 0 and k is 1. In certain embodiments, n is 1, j is 1 and k is 1. In certain embodiments, n is 2, j is 1 and k is 0. In certain embodiments, n is 2, j is 0 and k is 1. In certain embodiments, n is 2, j is 1 and k is 1. In certain embodiments, n is 3, j is 1 and k is 0. In certain embodiments, n is 3, j is 0 and k is 1. In certain embodiments, n is 3, j is 1 and k is 1.

In certain embodiments, conjugate groups comprise cell-targeting moieties that have at least one tethered ligand. In certain embodiments, cell-targeting moieties comprise two tethered ligands covalently attached to a branching group.

In certain embodiments, each ligand of a cell-targeting moiety has an affinity for at least one type of receptor on a target cell. In certain embodiments, each ligand has an affinity for at least one type of receptor on the surface of a mammalian liver cell. In certain embodiments, each ligand has an affinity for the hepatic asialoglycoprotein receptor (ASGP-R). In certain embodiments, each ligand is a carbohydrate.

In certain embodiments, oligomeric compounds comprise a conjugate group comprising a cell-targeting moiety having an affinity for transferrin receptor (TfR), also known as TfR1 and CD71. In certain embodiments, the conjugate group comprises an anti-TfR1 antibody or fragment thereof. In certain embodiments, the anti-TfR1 antibody or fragment thereof can be any known in the art including but not limited to those described in WO/1991/004753; WO/2013/103800; WO/2014/144060; WO/2016/081643; WO2016/179257; WO/2016/207240; WO/2017/221883; WO/2018/129384; WO/2018/124121; WO/2019/151539; WO/2020/132584; WO/2020/028864; U.S. Pat. Nos. 7,208,174; 9,034,329; and 10,550,188. In certain embodiments, a fragment of an anti-TfR1 antibody is $F(ab')_2$, Fab, Fab', Fv, or scFv.

In certain embodiments, the conjugate group comprises a protein or peptide capable of binding TfR1. In certain embodiments, the protein or peptide capable of binding TfR1 can be any known in the art including but not limited to those described in WO/2019/140050; WO/2020/037150; WO/2020/124032; and U.S. Pat. No. 10,138,483.

In certain embodiments, the conjugate group comprises an aptamer capable of binding TfR1. In certain embodiments, the aptamer capable of binding TfR1 can be any known in the art including but not limited to those described in WO/2013/163303; WO/2019/033051; and WO/2020/245198.

B. Certain Terminal Groups

In certain embodiments, oligomeric compounds comprise one or more terminal groups. In certain such embodiments, oligomeric compounds comprise a stabilized 5'-phosphate. Stabilized 5'-phosphates include, but are not limited to 5'-phosphonates, including, but not limited to 5'-vinylphosphonates. In certain embodiments, terminal groups comprise one or more abasic sugar moieties and/or inverted nucleosides. In certain embodiments, terminal groups comprise one or more 2'-linked nucleosides or sugar moieties. In certain such embodiments, the 2'-linked group is an abasic sugar moiety.

III. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce or inhibit the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA or dsRNAi) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or animal.

IV. Certain Target Nucleic Acids

In certain embodiments, oligomeric compounds comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target RNA is a mature mRNA. In certain embodiments, the target nucleic acid is a pre-mRNA. In certain embodiments, the target region is entirely within an intron. In certain embodiments, the target region spans an intron/exon junction. In certain embodiments, the target region is at least 50% within an intron.

A. Complementarity/Mismatches to the Target Nucleic Acid and Duplex Complementarity In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a region that is 100% or fully complementary to a target nucleic acid. In certain embodiments, the region of full complementarity is from 6 to 20, 10 to 18, or 18 to 20 nucleobases in length.

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, or 8 from the 5'-end of the gap region. In certain embodiments, the mismatch is at position 9, 8, 7, 6, 5, 4, 3, 2, 1 from the 3'-end of the gap region. In certain embodiments, the mismatch is at position 1, 2, 3, or 4 from the 5'-end of the wing region. In certain embodiments, the mismatch is at position 4, 3, 2, or 1 from the 3'-end of the wing region.

B. PLN

In certain embodiments, oligomeric agents or oligomeric compounds comprise or consist of an oligonucleotide comprising a region that is complementary to a target nucleic acid, wherein the target nucleic acid is PLN. In certain embodiments, PLN nucleic acid has the sequence set forth in SEQ ID NO: 1 (GENBANK Accession No. NM_002667.4) or SEQ ID NO: 2 (GENBANK Accession No. NC_000006.12, truncated from nucleosides 118545001 to 118565000). In certain embodiments, contacting a cell with an oligomeric compound complementary to SEQ ID NOs: 1 or 2 reduces the amount of PLN RNA, and in certain embodiments reduces the amount of PLN protein. In certain embodiments, the oligomeric compound consists of a modified oligonucleotide. In certain embodiments, the oligomeric compound consists of a modified oligonucleotide and a conjugate group.

C. Certain Target Nucleic Acids in Certain Tissues

In certain embodiments, oligomeric compounds comprise or consist of an oligonucleotide comprising a region that is complementary to a target nucleic acid, wherein the target nucleic acid is expressed in a pharmacologically relevant tissue. In certain embodiments, the pharmacologically relevant tissues are the heart cells and tissues.

V. Certain Methods and Uses

Certain embodiments provided herein relate to methods of inhibiting PLN expression, which can be useful for treating a disease associated with PLN in a subject, by administration of an oligomeric agent, oligomeric compound, modified oligonucleotide, or oligomeric duplex, any of which comprising a modified oligonucleotide having a nucleobase sequence complementary to a PLN nucleic acid.

Examples of diseases associated with PLN treatable with the oligomeric agents, oligomeric compounds, modified oligonucleotides, oligomeric duplexes, and methods provided herein include cardiomyopathy, heart failure, or arrhythmia. In certain embodiments, cardiomyopathy is genetic, including p.Arg14del, Arg9Cys (R9C), and Arg25Cys (R25C) mutations. In certain embodiments, cardiomyopathy is dilated cardiomyopathy (DCM). In certain embodiments, DCM is genetic, including TTN, LMNA, RBM20, SCN5A, MYH7, TNNT2, and TPM1 mutations. In certain embodiments, DCM is arrhythmogenic DCM. In certain embodiments, heart failure is heart failure with preserved ejection fraction (HFpEF), heart failure with reduced ejection fraction (HFrEF), acute heart failure, or worsening of chronic heart failure. In certain embodiments, arrhythmia is ventricular tachycardia (Vtac) or ventricular fibrillation (Vfib).

In certain embodiments, a method comprises administering to a subject an oligomeric agent, oligomeric compound, modified oligonucleotide, or oligomeric duplex, any of which having a nucleobase sequence complementary to a PLN nucleic acid. In certain embodiments, the subject has cardiomyopathy, heart failure, or arrhythmia. In certain embodiments, cardiomyopathy is genetic, including p.Arg14del, Arg9Cys (R9C), and Arg25Cys (R25C) mutations. In certain embodiments, cardiomyopathy is dilated cardiomyopathy (DCM). In certain embodiments, DCM is genetic, including TTN, LMNA, RBM20, SCN5A, MYH7, TNNT2, and TPM1 mutations. In certain embodiments, DCM is arrhythmogenic DCM. In certain embodiments, heart failure is heart failure with preserved ejection fraction (HFpEF), heart failure with reduced ejection fraction (HFrEF), acute heart failure, or worsening of chronic heart failure. In certain embodiments, arrhythmia is ventricular tachycardia (Vtac) or ventricular fibrillation (Vfib).

In certain embodiments, a method of treating cardiomyopathy, heart failure, or arrhythmia in a subject comprises administering to the subject a therapeutically effective amount of an oligomeric agent, oligomeric compound, modified oligonucleotide, or oligomeric duplex, any of which having a nucleobase sequence complementary to a PLN nucleic acid, thereby treating the subject. In certain embodiments, cardiomyopathy is genetic, including p.Arg14del, Arg9Cys (R9C), and Arg25Cys (R25C) mutations. In certain embodiments, cardiomyopathy is dilated cardiomyopathy (DCM). In certain embodiments, DCM is genetic, including TTN, LMNA, RBM20, SCN5A, MYH7, TNNT2, and TPM1 mutations. In certain embodiments, DCM is arrhythmogenic DCM. In certain embodiments, heart failure is heart failure with preserved ejection fraction (HFpEF), heart failure with reduced ejection fraction (HFrEF), acute heart failure, or worsening of chronic heart failure. In certain embodiments, arrhythmia is ventricular tachycardia (Vtac) or ventricular fibrillation (Vfib). In certain embodiments, administering the therapeutically effective amount of the oligomeric agent, oligomeric compound, modified oligonucleotide, or oligomeric duplex improves cardiac function, cardiovascular death, cardiac dilation, cardiac fibrosis, low voltage ECG, diastolic calcium uptake, ejection fraction (EF), left ventricular ejection fraction (LVEF), left ventricular end systolic volume (LVESV), left ventricular end diastolic volume (LVEDV), mitral valve flow profile, left ventricle (LV) strain, left ventricle (LV) strain rate, infarct size, heart failure hospitalization, 6 minute walk test (6MWT), the Kansas City Cardiomyopathy Questionnaire Score (KCCQS), heart rate, or heart rhythm in the subject.

In certain embodiments, a method of inhibiting expression of PLN nucleic acid, such as RNA, in a subject having a disease associated with PLN comprises administering to the subject an oligomeric agent, oligomeric compound, modified oligonucleotide, or oligomeric duplex, any of which having a nucleobase sequence complementary to a PLN nucleic acid, thereby inhibiting expression of PLN nucleic acid in the subject. In certain embodiments, administering the oligomeric agent, oligomeric compound, modified oligonucleotide, or oligomeric duplex inhibits expression of PLN in the heart. In certain embodiments, the subject has cardiomyopathy, heart failure, or arrhythmia. In certain embodiments, cardiomyopathy is genetic, including p.Arg14del, Arg9Cys (R9C), and Arg25Cys (R25C) mutations. In certain embodiments, cardiomyopathy is dilated cardiomyopathy (DCM). In certain embodiments, DCM is genetic, including TTN, LMNA, RBM20, SCN5A, MYH7, TNNT2, and TPM1 mutations. In certain embodiments, DCM is arrhythmogenic DCM. In certain embodiments, heart failure is heart failure with preserved ejection fraction (HFpEF), heart failure with reduced ejection fraction (HFrEF), acute heart failure, or worsening of chronic heart failure. In certain embodiments, arrhythmia is ventricular tachycardia (Vtac) or ventricular fibrillation (Vfib).

In certain embodiments, a method of inhibiting expression of PLN nucleic acid in a cell comprises contacting the cell with an oligomeric agent, oligomeric compound, modified oligonucleotide, or oligomeric duplex, any of which having a nucleobase sequence complementary to a PLN nucleic acid, thereby inhibiting expression of PLN nucleic acid in the cell. In certain embodiments, the cell is a heart cell. In certain embodiments, the cell is in a subject having cardiomyopathy, heart failure, or arrhythmia. In certain embodiments, cardiomyopathy is genetic, including p.Arg14del, Arg9Cys (R9C), and Arg25Cys (R25C) mutations. In certain embodiments, cardiomyopathy is dilated cardiomyopathy (DCM). In certain embodiments, DCM is genetic, including TTN, LMNA, RBM20, SCN5A, MYH7, TNNT2, and TPM1 mutations. In certain embodiments, DCM is arrhythmogenic DCM. In certain embodiments, heart failure is heart failure with preserved ejection fraction (HFpEF), heart failure with reduced ejection fraction (HFrEF), acute heart failure, or worsening of chronic heart failure. In certain embodiments, arrhythmia is ventricular tachycardia (Vtac) or ventricular fibrillation (Vfib).

Certain embodiments are drawn to an oligomeric agent, oligomeric compound, modified oligonucleotide, or oligomeric duplex, any of which having a nucleobase sequence complementary to a PLN nucleic acid, for use in treating a disease associated with PLN. In certain embodiments, the disease is cardiomyopathy, heart failure, or arrhythmia. In certain embodiments, cardiomyopathy is genetic, including p.Arg14del, Arg9Cys (R9C), and Arg25Cys (R25C) mutations. In certain embodiments, cardiomyopathy is dilated cardiomyopathy (DCM). In certain embodiments, DCM is genetic, including TTN, LMNA, RBM20, SCN5A, MYH7, TNNT2, and TPM1 mutations. In certain embodiments, DCM is arrhythmogenic DCM. In certain embodiments, heart failure is heart failure with preserved ejection fraction (HFpEF), heart failure with reduced ejection fraction (HFrEF), acute heart failure, or worsening of chronic heart failure. In certain embodiments, arrhythmia is ventricular tachycardia (Vtac) or ventricular fibrillation (Vfib). In certain embodiments, an oligomeric agent, oligomeric compound, modified oligonucleotide, or oligomeric duplex is for use in improving cardiac function, cardiovascular death, cardiac dilation, cardiac fibrosis, low voltage ECG, diastolic calcium uptake, ejection fraction (EF), left ventricular ejection fraction (LVEF), left ventricular end systolic volume (LVESV), left ventricular end diastolic volume (LVEDV), mitral valve flow profile, left ventricle (LV) strain, left ventricle (LV) strain rate, infarct size, heart failure hospitalization, 6 minute walk test (6MWT), the Kansas City Cardiomyopathy Questionnaire Score (KCCQS), heart rate, or heart rhythm associated with cardiomyopathy, heart failure, or arrhythmia.

Certain embodiments are drawn to an oligomeric agent, oligomeric compound, modified oligonucleotide, or oligomeric duplex, any of which comprising a modified oligonucleotide having a nucleobase sequence complementary to a PLN nucleic acid, for the manufacture or preparation of a medicament for treating a disease associated with PLN. In certain embodiments, the disease is cardiomyopathy, heart failure, or arrhythmia. In certain embodiments, an oligomeric agent, oligomeric compound, modified oligonucleotide, or oligomeric duplex is for the manufacture or preparation of a medicament for improving cardiac function, cardiovascular death, cardiac dilation, cardiac fibrosis, low voltage ECG, diastolic calcium uptake, ejection fraction (EF), left ventricular ejection fraction (LVEF), left ventricular end systolic volume (LVESV), left ventricular end diastolic volume (LVEDV), mitral valve flow profile, left ventricle (LV) strain, left ventricle (LV) strain rate, infarct size, heart failure hospitalization, 6 minute walk test (6MWT), the Kansas City Cardiomyopathy Questionnaire Score (KCCQS), heart rate, or heart rhythm associated with cardiomyopathy, heart failure, or arrhythmia. In certain embodiments, cardiomyopathy is genetic, including p.Arg14del, Arg9Cys (R9C), and Arg25Cys (R25C) mutations. In certain embodiments, cardiomyopathy is dilated cardiomyopathy (DCM). In certain embodiments, DCM is genetic, including TTN, LMNA, RBM20, SCN5A, MYH7, TNNT2, and TPM1 mutations. In certain embodiments, DCM is arrhythmogenic DCM. In certain embodiments, heart failure is heart failure with preserved ejection fraction (HFpEF), heart failure with reduced ejection fraction (HFrEF), acute heart failure, or worsening of chronic heart failure. In certain embodiments, arrhythmia is ventricular tachycardia (Vtac) or ventricular fibrillation (Vfib).

In any of the methods or uses described herein, the oligomeric agent, oligomeric compound, modified oligonucleotide, or oligomeric duplex can be any described herein.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to an animal, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents.

Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Under certain conditions, certain compounds disclosed herein act as acids. Although such compounds may be drawn or described in protonated (free acid) form, or ionized and in association with a cation (salt) form, aqueous solutions of such compounds exist in equilibrium among such forms. For example, a phosphate linkage of an oligonucleotide in aqueous solution exists in equilibrium among free acid, anion and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or a salt thereof" expressly includes all such forms that may be fully or partially protonated/de-protonated/in association with a cation. In certain instances, one or more specific cation is identified.

In certain embodiments, modified oligonucleotides or oligomeric compounds are in aqueous solution with sodium. In certain embodiments, modified oligonucleotides or oligomeric compounds are in aqueous solution with potassium. In certain embodiments, modified oligonucleotides or oligomeric compounds are in PBS. In certain embodiments, modified oligonucleotides or oligomeric compounds are in water. In certain such embodiments, the pH of the solution is adjusted with NaOH and/or HCl to achieve a desired pH.

VII. Certain Hotspot Regions

1. Nucleobases 3341-3368 of SEQ ID NO: 2

In certain embodiments, nucleobases 3341-3368 of SEQ ID NO: 2 comprise a hotspot region. In certain embodiments, modified oligonucleotides are complementary within nucleobases 3341-3368 of SEQ ID NO: 2. In certain embodiments, modified oligonucleotides are 16 nucleobases in length. In certain embodiments, modified oligonucleotides are gapmers. In certain embodiments, the gapmers are cEt gapmers. In certain embodiments, the gapmers are mixed MOE/cEt gapmers. In certain embodiments, the gapmers are mixed 2'-OMe/cEt gapmers. In certain embodiments, the sugar motif for the gapmers are selected from (from 5' to 3'): kkkddddddddddkkk, kkddddddddddkekek, kkkdydddddddkkk, kkkdddddddddkkke; wherein each "d" represents a 2'-β-D-deoxyribosyl sugar moiety, each "e" represents a 2'-MOE sugar moiety, each "y" represents a 2'-OMe sugar moiety, and each "k" represents a cEt modified sugar moiety. Each cytosine residue is a 5-methyl cytosine. In certain embodiments, the nucleosides of the modified oligonucleotides are linked by a combination of phosphodiester and phosphorothioate internucleoside linkages. In certain embodiments, the nucleosides of the modified oligonucleotides are linked by phosphorothioate internucleoside linkages.

The nucleobase sequences of SEQ ID Nos: 636, 756, 818, 864, 1416, 1419, 1512, 1513, 1530, 1563, 1622, 1623, and 1625 are complementary within nucleobases 3341-3368 of SEQ ID NO: 2.

Compounds 1342326, 1342342, 1342785, 1342952, 1343238, 1343301, 1343367, 1393388, 1393391, 1393544, 1393555, 1393557, 1393559, 1393562, 1393563, 1393745, 1393747, 1393748, 1393749, 1393750, 1393753, 1393934, 1393935, 1393936, 1393939, 1393940, 1393942, 1393997, 1394043, 1394091, 1446717, 1446691, and 1446737 are complementary within nucleobases 3341-3368 of SEQ ID NO: 2.

In certain embodiments, modified oligonucleotides complementary within nucleobases 3341-3368 of SEQ ID NO: 2 achieve at least 58% reduction of PLN RNA in vitro in the standard cell assay. In certain embodiments, modified oligonucleotides complementary within nucleobases 3341-3368 of SEQ ID NO: 2 achieve an average of 77% reduction of PLN RNA in vitro in the standard cell assay.

2. Nucleobases 4516-4533 of SEQ ID NO: 2

In certain embodiments, nucleobases 4516-4533 of SEQ ID NO: 2 comprise a hotspot region. In certain embodiments, modified oligonucleotides are complementary within nucleobases 4516-4533 of SEQ ID NO: 2. In certain embodiments, modified oligonucleotides are 16 nucleobases in length. In certain embodiments, modified oligonucleotides are gapmers. In certain embodiments, the gapmers are cEt gapmers. In certain embodiments, the gapmers are mixed MOE/cEt gapmers. In certain embodiments, the gapmers are mixed 2'-OMe/cEt gapmers. In certain embodiments, the sugar motif for the gapmers are selected from (from 5' to 3'): kkkddddddddddkkk, kkddddddddddkekek, kkkdddddddddkkke, kkkdydddddddkkk; wherein each "d" represents a 2'-β-D-deoxyribosyl sugar moiety, each "e" represents a 2'-MOE sugar moiety, each "y" represents a 2'-OMe sugar moiety, and each "k" represents a cEt modified sugar moiety. Each cytosine residue is a 5-methyl cytosine. In certain embodiments, the nucleosides of the modified oligonucleotides are linked by a combination of phosphodiester and phosphorothioate internucleoside linkages. In certain embodiments, the nucleosides of the modified oligonucleotides are linked by phosphorothioate internucleoside linkages.

The nucleobase sequences of SEQ ID Nos: 828, 1415, 1420, 1617, and 1621 are complementary within nucleobases 4516-4533 of SEQ ID NO: 2.

Compounds 1342919, 1393387, 1393392, 1393547, 1393551, 1393553, 1393736, 1393737, 1393742, 1393927, 1393929, 1393933, and 1446694 are complementary within nucleobases 4516-4533 of SEQ ID NO: 2.

In certain embodiments, modified oligonucleotides complementary within nucleobases 4516-4533 of SEQ ID NO: 2 achieve at least 60% reduction of PLN RNA in vitro in the standard cell assay. In certain embodiments, modified oligonucleotides complementary within nucleobases 4516-4533 of SEQ ID NO: 2 achieve an average of 80% reduction of PLN RNA in vitro in the standard cell assay.

3. Nucleobases 5498-5517 of SEQ ID NO: 2

In certain embodiments, nucleobases 5498-5517 of SEQ ID NO: 2 comprise a hotspot region. In certain embodiments, modified oligonucleotides are complementary within nucleobases 5498-5517 of SEQ ID NO: 2. In certain embodiments, modified oligonucleotides are 14, 16, 17, 18 or 20 nucleobases in length. In certain embodiments, modified oligonucleotides are gapmers. In certain embodiments, the gapmers are cEt gapmers. In certain embodiments, the gapmers are mixed MOE/cEt gapmers. In certain embodiments, the gapmers are mixed 2'-OMe/cEt gapmers. In certain embodiments, the sugar motif for the gapmers are selected from (from 5' to 3'): kkkddddddddddkkk, kkddddddddddkekek, kkkdddddddddkkke, kkkdydddddddkkk, kkkkddddddddddkkkk, kkddddddddddkk, kkkddddddddddkkkk, kkkkkddddddddddkkkkk, kkkkddddddddddkkk, kkkddddddddddkkee, kkkddddddddddkeee, kkkddddddddddkkeee, kkkddddddddddkeeee, ekkddddddddddkkk, kekddddddddddkkk, kkedddddddddddkkk, ekkddddddddddkkke, kekddddddddddkkke, kkeddddddddddkkke; wherein each "d" represents a 2'-β-D-deoxyribosyl sugar moiety, each "e" represents a 2'-MOE sugar moiety, each "y" represents a 2'-OMe sugar moiety, and each "k" represents a cEt modified sugar moiety. Each cytosine residue is a 5-methyl cytosine. In certain embodiments, the nucleosides of the modified oligonucleotides are linked by a combination of phosphodiester and phosphorothioate internucleoside linkages. In certain embodiments, the nucleosides of the modified oligonucleotides are linked by phosphorothioate internucleoside linkages.

The nucleobase sequences of SEQ ID Nos: 538, 609, 675, 737, 1396, 1595, 1671, 1678, 1685, 1689, 1696, 1700, and 1703 are complementary within nucleobases 5498-5517 of SEQ ID NO: 2.

Compounds 1342668, 1342944, 1343077, 1343091, 1393355, 1393486, 1393487, 1393489, 1393490, 1393493, 1393674, 1393675, 1393676, 1393677, 1393682, 1393863, 1393866, 1393868, 1393869, 1393871, 1446729, 1446701, 1436544, 1446730, 1436542, 1528609, 1528610, 1528619, 1528620, 1528629, 1528630, 1528638, 1528639, 1528640, 1528649, 1528650, 1528662, 1528663, 1528671, 1528672, 1528682, 1528683, 1528842, 1528846, 1528850, 1528855, 1528858, and 1528864 are complementary within nucleobases 5498-5517 of SEQ ID NO: 2.

In certain embodiments, modified oligonucleotides complementary within nucleobases 5498-5517 of SEQ ID NO: 2 achieve at least 40% reduction of PLN RNA in vitro in the standard cell assay. In certain embodiments, modified oligonucleotides complementary within nucleobases 5498-5517 of SEQ ID NO: 2 achieve an average of 76% reduction of PLN RNA in vitro in the standard cell assay.

4. Nucleobases 14337-14357 of SEQ ID NO: 2

In certain embodiments, nucleobases 14337-14357 of SEQ ID NO: 2 comprise a hotspot region. In certain embodiments, modified oligonucleotides are complementary within nucleobases 14337-14357 of SEQ ID NO: 2. In certain embodiments, modified oligonucleotides are 16 nucleobases in length. In certain embodiments, modified oligonucleotides are gapmers. In certain embodiments, the gapmers are cEt gapmers. In certain embodiments, the gapmers are mixed MOE/cEt gapmers. In certain embodiments, the gapmers are mixed 2'-OMe/cEt gapmers. In certain embodiments, the sugar motif for the gapmers are selected from (from 5' to 3'): kkkddddddddddkkk, kkddddddddddkekek, kkkddddddddddkkke, kkkdyddddddddkkk; wherein each "d" represents a 2'-β-D-deoxyribosyl sugar moiety, each "e" represents a 2'-MOE sugar moiety, each "y" represents a 2'-OMe sugar moiety, and each "k" represents a cEt modified sugar moiety. Each cytosine residue is a 5-methyl cytosine. In certain embodiments, the nucleosides of the modified oligonucleotides are linked by a combination of phosphodiester and phosphorothioate internucleoside linkages. In certain embodiments, the nucleosides of the modified oligonucleotides are linked by phosphorothioate internucleoside linkages.

The nucleobase sequences of SEQ ID Nos 336, 1360, 1469, 1485, 1486, 1488, 1600, and 1603 are complementary within nucleobases 14337-14357 of SEQ ID NO: 2.

Compounds 1342523, 1342787, 1393367, 1393369, 1393371, 1393505, 1393508, 1393509, 1393512, 1393694, 1393696, 1393697, 1393698, 1393885, 1393887, 1393892, 1393893, 1393983, 1394029, 1394079, 1394104, 1446735, 1446697, 1446723, 1443260, and 1446741 are complementary within nucleobases 14337-14357 of SEQ ID NO: 2.

In certain embodiments, modified oligonucleotides complementary within nucleobases 14337-14357 of SEQ ID NO: 2 achieve at least 64% reduction of PLN RNA in vitro in the standard cell assay. In certain embodiments, modified oligonucleotides complementary within nucleobases 14337-14357 of SEQ ID NO: 2 achieve an average of 81% reduction of PLN RNA in vitro in the standard cell assay.

5. Nucleobases 14569-14588 of SEQ ID NO: 2

In certain embodiments, nucleobases 14569-14588 of SEQ ID NO: 2 comprise a hotspot region. In certain embodiments, modified oligonucleotides are complementary within nucleobases 14569-14588 of SEQ ID NO: 2. In certain embodiments, modified oligonucleotides are 16 nucleobases in length. In certain embodiments, modified oligonucleotides are gapmers. In certain embodiments, the gapmers are cEt gapmers. In certain embodiments, the gapmers are mixed MOE/cEt gapmers. In certain embodiments, the gapmers are mixed 2'-OMe/cEt gapmers. In certain embodiments, the sugar motif for the gapmers are selected from (from 5' to 3'): kkkddddddddddkkk, kkddddddddddkekek, kkkddddddddddkkke, kkkdyddddddddkkk; wherein each "d" represents a 2'-β-D-deoxyribosyl sugar moiety, each "e" represents a 2'-MOE sugar moiety, each "y" represents a 2'-OMe sugar moiety, and each "k" represents a cEt modified sugar moiety. Each cytosine residue is a 5-methyl cytosine. In certain embodiments, the nucleosides of the modified oligonucleotides are linked by a combination of phosphodiester and phosphorothioate internucleoside linkages. In certain embodiments, the nucleosides of the modified oligonucleotides are linked by phosphorothioate internucleoside linkages.

The nucleobase sequences of SEQ ID Nos 1072, 1136, 1407, 1411, and 1615 are complementary within nucleobases 14569-14588 of SEQ ID NO: 2.

Compounds 1342898, 1343100, 1393379, 1393383, 1393535, 1393536, 1393537, 1393540, 1393726, 1393727, 1393728, 1393732, 1393916, 1393917, 1393919, 1393920, and 1446733 are complementary within nucleobases 14569-14588 of SEQ ID NO: 2.

In certain embodiments, modified oligonucleotides complementary within nucleobases 14569-14588 of SEQ ID NO: 2 achieve at least 44% reduction of PLN RNA in vitro in the standard cell assay. In certain embodiments, modified oligonucleotides complementary within nucleobases 14569-14588 of SEQ ID NO: 2 achieve an average of 77% reduction of PLN RNA in vitro in the standard cell assay.

6. Nucleobases 14607-14631 of SEQ ID NO: 2

In certain embodiments, nucleobases 14607-14631 of SEQ ID NO: 2 comprise a hotspot region. In certain embodiments, modified oligonucleotides are complementary within nucleobases 14607-14631 of SEQ ID NO: 2. In certain embodiments, modified oligonucleotides are 16 nucleobases in length. In certain embodiments, modified oligonucleotides are gapmers. In certain embodiments, the gapmers are cEt gapmers. In certain embodiments, the gapmers are mixed MOE/cEt gapmers. In certain embodiments, the gapmers are mixed 2'-OMe/cEt gapmers. In certain embodiments, the sugar motif for the gapmers are selected from (from 5' to 3'): kkkddddddddddkkk, kkddddddddddkekek, kkkdyddddddddkkk, kkkddddddddddkkke; wherein each "d" represents a 2'-β-D-deoxyribosyl sugar moiety, each "e" represents a 2'-MOE sugar moiety, each "y" represents a 2'-OMe sugar moiety, and each "k" represents a cEt modified sugar moiety. Each cytosine residue is a 5-methyl cytosine. In certain embodiments, the nucleosides of the modified oligonucleotides are linked by a combination of phosphodiester and phosphorothioate internucleoside linkages. In certain embodiments, the nucleosides of the modified oligonucleotides are linked by phosphorothioate internucleoside linkages.

The nucleobase sequences of SEQ ID Nos 35, 110, 355, 457, 505, 611, 1234, 1269, 1319, 1500, 1548, 1568, and 1578 are complementary within nucleobases 14607-14631 of SEQ ID NO: 2.

Compounds 1121401, 1121402, 1342190, 1342569, 1342673, 1342749, 1343124, 1343142, 1343172, 1343258, 1343263, 1343320, 1343322, 1343357, 1343360, 1343438, 1343439, 1343440, 1343442, 1343444, 1343548, 1343549, 1343551, 1343552, 1343553, 1343626, 1343629, 1343631, 1343633, 134363, 1443234, and 1443241 are complementary within nucleobases 14607-14631 of SEQ ID NO: 2.

In certain embodiments, modified oligonucleotides complementary within nucleobases 14607-14631 of SEQ ID NO: 2 achieve at least 38% reduction of PLN RNA in vitro in the standard cell assay. In certain embodiments, modified oligonucleotides complementary within nucleobases 14607-14631 of SEQ ID NO: 2 achieve an average of 74% reduction of PLN RNA in vitro in the standard cell assay.

7. Nucleobases 14683-14703 of SEQ ID NO: 2

In certain embodiments, nucleobases 14683-14703 of SEQ ID NO: 2 comprise a hotspot region. In certain embodiments, modified oligonucleotides are complementary within nucleobases 14683-14703 of SEQ ID NO: 2. In certain embodiments, modified oligonucleotides are 14, 16, 17, 18 or 20 nucleobases in length. In certain embodiments, modified oligonucleotides are gapmers. In certain embodiments, the gapmers are cEt gapmers. In certain embodiments, the gapmers are mixed MOE/cEt gapmers. In certain embodiments, the gapmers are mixed 2'-OMe/cEt gapmers. In certain embodiments, the sugar motif for the gapmers are selected from (from 5' to 3'): kkkddddddddddkkk, kkddddddddddkekek, kkkdyddddddddkkk, kkkddddddddddkkke, kkkkddddddddddkkkk, kkkkkddddddddddkkkkk, kkddddddddddkk, kkkddddddddddkkkk, kkkkddddddddddkkk, kkkddddddddddkkee, kkkddddddddddkeee, kkkddddddddddkkeee, kkkddddddddddkeeee, ekkddddddddddkkk, kekddddddddddkkk, kkedddddddddkkk; wherein each "d" represents a 2'-β-D-deoxyribosyl sugar moiety, each "e" represents a 2'-MOE sugar moiety, each "y" represents a 2'-OMe sugar moiety, and each "k" represents a cEt modified sugar moiety. Each cytosine residue is a 5-methyl cytosine. In certain embodiments, the nucleosides of the modified oligonucleotides are linked by a combination of phosphodiester and phosphorothioate internucleoside linkages. In certain embodiments, the nucleosides of the modified oligonucleotides are linked by phosphorothioate internucleoside linkages.

The nucleobase sequences of SEQ ID Nos 185, 464, 474, 590, 647, 719, 1547, 1677, 1684, 1695, 1699, and 1708 are complementary within nucleobases 14683-14703 of SEQ ID NO: 2.

Compounds 1121403, 1342270, 1342393, 1342536, 1342754, 1343191, 1343436, 1343437, 1343454, 1343546, 1343562, 1343564, 1343627, 1343628, 1343630, 1443235, 1528607, 1528615, 1528617, 1528627, 1528636, 1528647, 1528658, 1528669, 1528679, 1528844, 1528848, 1528852 are complementary within nucleobases 14683-14703 of SEQ ID NO: 2.

In certain embodiments, modified oligonucleotides complementary within nucleobases 14683-14703 of SEQ ID NO: 2 achieve at least 42% reduction of PLN RNA in vitro in the standard cell assay. In certain embodiments, modified oligonucleotides complementary within nucleobases 14683-14703 of SEQ ID NO: 2 achieve an average of 63% reduction of PLN RNA in vitro in the standard cell assay.

8. Nucleobases 14828-14848 of SEQ ID NO: 2

In certain embodiments, nucleobases 14828-14848 of SEQ ID NO: 2 comprise a hotspot region. In certain embodiments, modified oligonucleotides are complementary within nucleobases 14828-14848 of SEQ ID NO: 2. In certain embodiments, modified oligonucleotides are 16 nucleobases in length. In certain embodiments, modified oligonucleotides are gapmers. In certain embodiments, the gapmers are cEt gapmers. In certain embodiments, the gapmers are mixed MOE/cEt gapmers. In certain embodiments, the gapmers are mixed 2'-OMe/cEt gapmers. In certain embodiments, the sugar motif for the gapmers are selected from (from 5' to 3'): kkkddddddddddkkk, kkddddddddddkekek, kkkdyddddddddkkk, kkkddddddddddkkke; wherein each "d" represents a 2'-β-D-deoxyribosyl sugar moiety, each "e" represents a 2'-MOE sugar moiety, each "y" represents a 2'-OMe sugar moiety, and each "k" represents a cEt modified sugar moiety. Each cytosine residue is a 5-methyl cytosine. In certain embodiments, the nucleosides of the modified oligonucleotides are linked by a combination of phosphodiester and phosphorothioate internucleoside linkages. In certain embodiments, the nucleosides of the modified oligonucleotides are linked by phosphorothioate internucleoside linkages.

The nucleobase sequences of SEQ ID Nos 39, 188, 264, 713, 802, 1502, and 1581 are complementary within nucleobases 14828-14848 of SEQ ID NO: 2.

Compounds 1121415, 1121416, 1121417, 1342279, 1342607, 1343264, 1343316, 1343373, 1343457, 1343460, 1343461, 1343462, 1343465, 1343567, 1343569, 1343570, 1343571, 1343574, 1343649, 1343651, 1343652, 1343653, 1343655, 1443240, 1443266, 1443243, 1443270, and 1443245 are complementary within nucleobases 14828-14848 of SEQ ID NO: 2.

In certain embodiments, modified oligonucleotides complementary within nucleobases 14828-14848 of SEQ ID NO: 2 achieve at least 43% reduction of PLN RNA in vitro in the standard cell assay. In certain embodiments, modified oligonucleotides complementary within nucleobases 14828-14848 of SEQ ID NO: 2 achieve an average of 68% reduction of PLN RNA in vitro in the standard cell assay.

9. Nucleobases 14939-14958 of SEQ ID NO: 2

In certain embodiments, nucleobases 14939-14958 of SEQ ID NO: 2 comprise a hotspot region. In certain embodiments, modified oligonucleotides are complementary within nucleobases 14939-14958 of SEQ ID NO: 2. In certain embodiments, modified oligonucleotides are 14, 16, 17, 18 or 20 nucleobases in length. In certain embodiments, modified oligonucleotides are gapmers. In certain embodiments, the gapmers are cEt gapmers. In certain embodiments, the gapmers are mixed MOE/cEt gapmers. In certain embodiments, the gapmers are mixed 2'-OMe/cEt gapmers. In certain embodiments, the sugar motif for the gapmers are selected from (from 5' to 3'): kkkddddddddddkkk, kkddddddddddkekek, kkkdyddddddddkkk, kkkddddddddddkkke, kkkddddddddddkeeee, kkkkddddddddddkkkk, kkddddddddddkk, kkkddddddddddkkkk, kkkkddddddddddkkk, kkkddddddddddkkee, kkkkkddddddddddkkkkk, kkkddddddddddkeee, kkkddddddddddkkeee, keddddddddd-kekek, ekddddddddddkekek, ekkddddddddddkkke, kekddddddddddkkke, kkedddddddddddkkk, kkedddddddddkkke; wherein each "d" represents a 2'-β-D- deoxyribosyl sugar moiety, each "e" represents a 2'-MOE sugar moiety, each "y" represents a 2'-OMe sugar moiety, and each "k" represents a cEt modified sugar moiety. Each cytosine residue is a 5-methyl cytosine. In certain embodiments, the nucleosides of the modified oligonucleotides are linked by a combination of phosphodiester and phosphorothioate internucleoside linkages.

In certain embodiments, the nucleosides of the modified oligonucleotides are linked by phosphorothioate internucleoside linkages.

The nucleobase sequences of SEQ ID Nos 45, 120, 270, 942, 1046, 1552, 1583, 1672, 1673, 1674, 1679, 1680, 1687, 1692, 1693, and 1710 are complementary within nucleobases 14939-14958 of SEQ ID NO: 2.

Compounds 1121440, 1121441, 1121442, 1342309, 1342630, 1343458, 1343467, 1343475, 1343578, 1343580, 1343584, 1343647, 1343648, 1343656, 1393344, 1393347, 1393575, 1393581, 1393766, 1393772, 1443259, 1446740, 1528604, 1528605, 1528606, 1528611, 1528612, 1528613, 1528621, 1528622, 1528623, 1528624, 1528631, 1528632, 1528633, 1528634, 1528642, 1528643, 1528644, 1528651, 1528652, 1528653, 1528654, 1528657, 1528664, 1528665, 1528666, 1528667, 1528675, 1528676, 1528677, 1528820, 1528834, 1528835, 1528836, 1528837, 1528838, 1528839, 1528840, 1528841, 1528854, 1528856, 1528857, 1528859, 1528862, and 1528863 are complementary within nucleobases 14939-14958 of SEQ ID NO: 2.

In certain embodiments, modified oligonucleotides complementary within nucleobases 14939-14958 of SEQ ID NO: 2 achieve at least 29% reduction of PLN RNA in vitro in the standard cell assay. In certain embodiments, modified oligonucleotides complementary within nucleobases 14939-14958 of SEQ ID NO: 2 achieve an average of 71% reduction of PLN RNA in vitro in the standard cell assay.

10. Nucleobases 15222-15243 of SEQ ID NO: 2

In certain embodiments, nucleobases 15222-15243 of SEQ ID NO: 2 comprise a hotspot region. In certain embodiments, modified oligonucleotides are complementary within nucleobases 15222-15243 of SEQ ID NO: 2. In certain embodiments, modified oligonucleotides are 14, 16, 17, 18 or 20 nucleobases in length. In certain embodiments, modified oligonucleotides are gapmers. In certain embodiments, the gapmers are cEt gapmers. In certain embodiments, the gapmers are mixed MOE/cEt gapmers. In certain embodiments, the gapmers are mixed 2'-OMe/cEt gapmers. In certain embodiments, the sugar motif for the gapmers are selected from (from 5' to 3'): kkkdddddddddkkk, kkddddddddddkekek, kkkdddddddddkkke, kkkdydd-ddddddkkk, kkkkddddddddddkkkk, kkddddddddddkk, kkkkkddddddddddkkkkk, kkkddddddddddkkkk, kkkkddddddddddkkk, kkkdddddddddkkee, kkkdddddddddkeee, kkkdddddddddkkeee, kkkdddddddddkeeee, ekkdddddddddddkkk, kekddddddddddkkk, kkeddddddddddkkk; wherein each "d" represents a 2'-β-D-deoxyribosyl sugar moiety, each "e" represents a 2'-MOE sugar moiety, each "y" represents a 2'-OMe sugar moiety, and each "k" represents a cEt modified sugar moiety. Each cytosine residue is a 5-methyl cytosine.

In certain embodiments, the nucleosides of the modified oligonucleotides are linked by a combination of phosphodiester and phosphorothioate internucleoside linkages. In certain embodiments, the nucleosides of the modified oligonucleotides are linked by phosphorothioate internucleoside linkages.

The nucleobase sequences of SEQ ID Nos 526, 613, 689, 752, 819, 1403, 1613, 1619, 1620, 1670, 1681, 1688, 1697, and 1702 are complementary within nucleobases 15222-15243 of SEQ ID NO: 2.

Compounds 1342794, 1342911, 1342959, 1343134, 1343156, 1393375, 1393534, 1393538, 1393541, 1393545, 1393546, 1393724, 1393730, 1393740, 1393741, 1393743, 1393914, 1393918, 1393924, 1393931, 1393932, 1446716, 1436543, 1446718, 1446704, 1528608, 1528618, 1528626, 1528628, 1528637, 1528648, 1528661, 1528670, 1528680, 1528843, 1528847, and 1528851 are complementary within nucleobases 15222-15243 of SEQ ID NO: 2.

In certain embodiments, modified oligonucleotides complementary within nucleobases 15222-15243 of SEQ ID NO: 2 achieve at least 23% reduction of PLN RNA in vitro in the standard cell assay. In certain embodiments, modified oligonucleotides complementary within nucleobases 15222-15243 of SEQ ID NO: 2 achieve an average of 68% reduction of PLN RNA in vitro in the standard cell assay.

11. Nucleobases 15251-15273 of SEQ ID NO: 2

In certain embodiments, nucleobases 15251-15273 of SEQ ID NO: 2 comprise a hotspot region. In certain embodiments, modified oligonucleotides are complementary within nucleobases 15251-15273 of SEQ ID NO: 2. In certain embodiments, modified oligonucleotides are 16 nucleobases in length. In certain embodiments, modified oligonucleotides are gapmers. In certain embodiments, the gapmers are cEt gapmers. In certain embodiments, the gapmers are mixed MOE/cEt gapmers. In certain embodiments, the gapmers are mixed 2'-OMe/cEt gapmers. In certain embodiments, the sugar motif for the gapmers are selected from (from 5' to 3'): kkkdddddddddkkk, kkdddddddddkekek, kkkdydddddddddkkk, kkkddddddddddkkke; wherein each "d" represents a 2'-β-D-deoxyribosyl sugar moiety, each "e" represents a 2'-MOE sugar moiety, each "y" represents a 2'-OMe sugar moiety, and each "k" represents a cEt modified sugar moiety. Each cytosine residue is a 5-methyl cytosine. In certain embodiments, the nucleosides of the modified oligonucleotides are linked by a combination of phosphodiester and phosphorothioate internucleoside linkages. In certain embodiments, the nucleosides of the modified oligonucleotides are linked by phosphorothioate internucleoside linkages.

The nucleobase sequences of SEQ ID Nos 53, 128, 278, 580, 638, 704, 784, 910, 1555, 1558, 1569, and 1647 are complementary within nucleobases 15251-15273 of SEQ ID NO: 2.

Compounds 1121472, 1121473, 1121474, 1342205, 1342256, 1342369, 1342548, 1342920, 1343275, 1343282, 1343334, 1343341, 1343384, 1343390, 1343478, 1343487, 1343493, 1343495, 1343588, 1343599, 1343603, 1343604, 1343666, 1343671, 1343676, 1343685, 1393408, 1393411, 1393595, 1393603, 1393784, 1393791, 1446720, and 1446713 are complementary within nucleobases 15251-15273 of SEQ ID NO: 2.

In certain embodiments, modified oligonucleotides complementary within nucleobases 15251-15273 of SEQ ID NO: 2 achieve at least 39% reduction of PLN RNA in vitro in the standard cell assay. In certain embodiments, modified oligonucleotides complementary within nucleobases 15251-15273 of SEQ ID NO: 2 achieve an average of 73% reduction of PLN RNA in vitro in the standard cell assay.

Nonlimiting Disclosure and Incorporation by Reference

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, ENSEMBL identifiers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of an uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^{m}$CGAUCG," wherein $^{m}$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^{1}H$ hydrogen atoms. Isotopic substitutions encompassed by the compounds herein include but are not limited to: $^{2}H$ or $^{3}H$ in place of $^{1}H$, $^{13}C$ or $^{14}C$ in place of $^{12}C$, $^{15}N$ in place of $^{14}N$, $^{17}O$ or $^{18}O$ in place of $^{16}O$, and $^{33}S$, $^{34}S$, $^{35}$, or $^{36}S$ in place of $^{32}S$. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1: Effect of 3-10-3 cEt Uniform Phosphorothioate Modified Oligonucleotides on Human PLN RNA In Vitro, Single Dose Modified oligonucleotides complementary to human PLN nucleic acid were designed and tested for their single dose effects on PLN RNA in vitro. The modified oligonucleotides were tested in a series of experiments that had the same culture conditions.

The modified oligonucleotides in the table below are 3-10-3 cEt modified oligonucleotides with uniform phosphorothioate internucleoside linkages. The modified oligonucleotides are 16 nucleosides in length, wherein the central gap segment consists of ten 2'-β-D-deoxynucleosides, and wherein the 5' and 3' wing segments each consist of three cEt nucleosides. The sugar motif for the modified oligonucleotides is (from 5' to 3'): kkkddddddddddkkk; wherein each "d" represents a 2'-β-D-deoxyribosyl sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

"Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the table below is 100% complementary to SEQ ID NO: 1 (GENBANK Accession No. NM_002667.4), to SEQ ID NO: 2 (GENBANK Accession No. NC_000006.12, truncated from nucleosides 118545001 to 118565000), or to both. "N/A" indicates that the modified oligonucleotide is not 100% complementary to that particular target nucleic acid sequence.

Cultured iCell® cardiomyocytes[2] (FujiFilm Cellular Dynamics, Inc.; Catalog No: R1017) were treated with modified oligonucleotide at a concentration of 5000 nM by electroporation at a density of 100,000 cells per well. After a treatment period of approximately 24 hours, total RNA was isolated from the cells and PLN RNA levels were measured by quantitative real-time RTPCR. PLN RNA levels were measured by human primer-probe set RTS40402 (forward sequence TGATGATCACAGCTGCCAA, designated herein as SEQ ID NO: 6; reverse sequence GACTTTCTCCATGATACCAGCA, designated herein as SEQ ID NO: 7; probe sequence CTCTCGACCACTTAAAACTTCAGACTTCCTG, designated herein as SEQ ID NO: 8). PLN RNA levels were normalized to total RNA content, as measured by RIBOGREEN®. Reduction of PLN RNA is presented in the table below as percent PLN RNA relative to the amount in untreated control cells (% UTC). The values marked with a "T" indicate that the modified oligonucleotide is complementary to the amplicon region of the primer probe set. Additional assays may be used to measure the potency and efficacy of the modified oligonucleotides complementary to the amplicon region.

Each separate experimental analysis described in this example is identified by a letter ID in the table column below labeled "AID" (Analysis ID).

TABLE 1

Reduction of PLN RNA by 3-10-3 cEt modified oligonucleotides with uniform phosphorothioate internucleoside linkages at a concentration of 5000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121324 | 19 | 34 | 3281 | 3296 | TGGGAACAGTTGCAGT | 141 | A | 15 |
| 1121328 | 25 | 40 | 3287 | 3302 | AGTTTATGGGAACAGT | 153 | A | 16 |
| 1121332 | 70 | 85 | 3332 | 3347 | AGTCTTACGGGTGTTT | 26 | A | 17 |
| 1121336 | 95 | 110 | 3357 | 3372 | CAGTATAGAGTATTGT | 58 | A | 18 |
| 1121340 | 127 | 142 | N/A | N/A | CTTTTAGGTAGCCTTG | 35† | A | 19 |
| 1121344 | 185 | 200 | 13879 | 13894 | TTTTAAGTGGTCGAGA | 53† | A | 20 |
| 1121348 | 212 | 227 | 13906 | 13921 | GATACCAGCAGGACAG | 34† | A | 21 |
| 1121351 | 242 | 25 | 13936 | 13951 | TGAGCGAGTGAGGTAT | 92 | A | 22 |
| 1121355 | 246 | 261 | 13940 | 13955 | TAGCTGAGCGAGTGAG | 112 | A | 23 |
| 1121359 | 250 | 265 | 13944 | 13959 | CTTATAGCTGAGCGAG | 89 | A | 24 |
| 1121363 | 259 | 274 | 13953 | 13968 | GAGGCTCTTCTTATAG | 76 | A | 25 |
| 1121367 | 264 | 279 | 13958 | 13973 | TGGTTGAGGCTCTTCT | 49 | A | 26 |
| 1121371 | 268 | 283 | 13962 | 13977 | TCAATGGTTGAGGCTC | 47 | A | 27 |
| 1121375 | 272 | 287 | 13966 | 13981 | CATTTCAATGGTTGAG | 40 | A | 28 |
| 1121378 | 276 | 291 | 13970 | 13985 | GAGGCATTTCAATGGT | 49 | A | 29 |
| 1121382 | 361 | 376 | 14055 | 14070 | ATCACGATGATACAGA | 45 | A | 30 |
| 1121386 | 390 | 405 | 14084 | 14099 | TAGAGGTTGTAGCAGA | 27 | A | 31 |
| 1121390 | 397 | 412 | 14091 | 14106 | GCAGATCTAGAGGTTG | 14 | A | 32 |
| 1121394 | 558 | 573 | 14252 | 14267 | GTTTACAAGATCCAAC | 58 | A | 33 |
| 1121397 | 815 | 830 | 14509 | 14524 | GATACTTGGTGAAGAC | 14 | A | 34 |
| 1121401 | 914 | 929 | 14608 | 14623 | TCTGATAGTTACTACA | 24 | A | 35 |
| 1121405 | 1014 | 1029 | 14708 | 14723 | GTAAGAGTATGGCCTT | 24 | A | 36 |
| 1121409 | 1067 | 1082 | 14761 | 14776 | GTACTAGAATTCTGTG | 46 | A | 37 |
| 1121413 | 1132 | 1147 | 14826 | 14841 | ATATTAACCACCAGTT | 51 | A | 38 |
| 1121417 | 1136 | 1151 | 14830 | 14845 | TCACATATTAACCACC | 25 | A | 39 |
| 1121421 | 1161 | 1176 | 14855 | 14870 | ATTAGTGATATGACTA | 58 | A | 40 |
| 1121425 | 1168 | 1183 | 14862 | 14877 | TTAGTATATTAGTGAT | 110 | A | 41 |
| 1121429 | 1209 | 1224 | 14903 | 14918 | TAATTCACTACAGTGC | 54 | A | 42 |
| 1121433 | 1229 | 1244 | 14923 | 14938 | CTAGGTAACTCTAGCT | 38 | A | 43 |
| 1121437 | 1242 | 1257 | 14936 | 14951 | ATAGTATGGTAAGCTA | 39 | A | 44 |
| 1121441 | 1247 | 1262 | 14941 | 14956 | AAGATATAGTATGGTA | 18 | A | 45 |
| 1121445 | 1311 | 1326 | 15005 | 15020 | TGTTAGGCTGGAATGG | 34 | A | 46 |
| 1121449 | 1457 | 1472 | 15151 | 15166 | AATAGATGGGCCAACA | 77 | A | 47 |

TABLE 1-continued

Reduction of PLN RNA by 3-10-3 cEt modified oligonucleotides with uniform phosphorothioate internucleoside linkages at a concentration of 5000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121453 | 1467 | 1482 | 15161 | 15176 | CTGTAGATGTAATAGA | 71 | A | 48 |
| 1121457 | 1510 | 1525 | 15204 | 15219 | CCACGAATTGTCAGCT | 23 | A | 49 |
| 1121461 | 1521 | 1536 | 15215 | 15230 | ATTTTGCGGACCCACG | 32 | A | 50 |
| 1121465 | 1527 | 1542 | 15221 | 15236 | GTTAAGATTTTGCGGA | 45 | A | 51 |
| 1121469 | 1539 | 1554 | 15233 | 15248 | GGCTATTAGGTAGTTA | 46 | A | 52 |
| 1121473 | 1561 | 1576 | 15255 | 15270 | GTAAGGTTTATGGTCA | 36 | A | 53 |
| 1121477 | 1607 | 1622 | 15301 | 15316 | ACATATAACACGCAAA | 31 | A | 54 |
| 1121481 | 1721 | 1736 | 15415 | 15430 | CTTTTATGTTGACCCA | 26 | A | 55 |
| 1121485 | 1815 | 1830 | 15509 | 15524 | ACCCCTAAGACAAGAC | 63 | A | 56 |
| 1121489 | 1900 | 1915 | 15594 | 15609 | TCCTATTACAGTTGAC | 67 | A | 57 |
| 1121493 | 1947 | 1962 | 15641 | 15656 | AAATAGATGCTTACCA | 75 | A | 58 |
| 1121497 | 1972 | 1987 | 15666 | 15681 | ATTTAGCTCAGTAGAG | 67 | A | 59 |
| 1121501 | 1992 | 2007 | 15686 | 15701 | ATAGCATAGCTGGATC | 49 | A | 60 |
| 1121505 | 2173 | 2188 | 15867 | 15882 | AGTATAGGTGTAAACT | 50 | A | 61 |
| 1121509 | 2216 | 2231 | 15910 | 15925 | TAGTAACATGTCTTCA | 56 | A | 62 |
| 1121513 | 2253 | 2268 | 15947 | 15962 | AATTACACATCCTCTA | 103 | A | 63 |
| 1121517 | 2285 | 2300 | 15979 | 15994 | CTTTTAGTAACCATGT | 50 | A | 64 |
| 1121521 | 2332 | 2347 | 16026 | 16041 | AGCAACACTTGTGTAA | 67 | A | 65 |
| 1121525 | 2340 | 2355 | 16034 | 16049 | ATTGAGTTAGCAACAC | 52 | A | 66 |
| 1121529 | 2345 | 2360 | 16039 | 16054 | TCACTATTGAGTTAGC | 92 | A | 67 |
| 1121533 | 2522 | 2537 | 16216 | 16231 | GTGTATCACCTGTTGT | 84 | A | 68 |
| 1121537 | 2575 | 2590 | 16269 | 16284 | TTAAGACTAGGGATAC | 85 | A | 69 |
| 1121541 | 2898 | 2913 | 16592 | 16607 | GTTTTTAGTGCCCTGT | 42 | A | 70 |
| 1121557 | N/A | N/A | 3804 | 3819 | GATGTAAATAGCTCAG | 16 | A | 71 |
| 1121561 | N/A | N/A | 4614 | 4629 | GATACCTCAGTGGTAG | 55 | A | 72 |
| 1121565 | N/A | N/A | 4969 | 4984 | AAGGTATAGATGAACT | 51 | A | 73 |
| 1121569 | N/A | N/A | 5677 | 5692 | AGTATATAGAGGATGT | 44 | A | 74 |
| 1121573 | N/A | N/A | 6177 | 6192 | CTGGGTAAGAACTTTG | 41 | A | 75 |
| 1121577 | N/A | N/A | 6471 | 6486 | CTTCTTAACCCTGTAG | 122 | A | 76 |
| 1121581 | N/A | N/A | 6943 | 6958 | CTTTTTTGGACTTGTG | 29 | A | 77 |
| 1121585 | N/A | N/A | 7458 | 7473 | GTAATATCAGATGCAT | 37 | A | 78 |
| 1121589 | N/A | N/A | 8415 | 8430 | GATGATAATTAGGCCA | 30 | A | 79 |
| 1121593 | N/A | N/A | 8942 | 8957 | CAATTTGTTAGTTGGA | 46 | A | 80 |
| 1121597 | N/A | N/A | 9545 | 9560 | TAGTATCCTAGTACTT | 105 | A | 81 |
| 1121601 | N/A | N/A | 9672 | 9687 | GTTTTTAATAGGGCTT | 50 | A | 82 |

TABLE 1-continued

Reduction of PLN RNA by 3-10-3 cEt modified oligonucleotides with uniform phosphorothioate internucleoside linkages at a concentration of 5000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121605 | N/A | N/A | 9938 | 9953 | AGCATATACAGGAGTC | 36 | A | 83 |
| 1121609 | N/A | N/A | 11302 | 11317 | AGTTATTAACTACCTG | 71 | A | 84 |
| 1121613 | N/A | N/A | 11634 | 11649 | CCTTTTATACATCCCA | 23 | A | 85 |
| 1121617 | N/A | N/A | 11740 | 11755 | GTAATTAACTGCCAGA | 42 | A | 86 |
| 1121621 | N/A | N/A | 11857 | 11872 | CTGTATTAACTGTCCA | 43 | A | 87 |
| 1121625 | N/A | N/A | 12474 | 12489 | GGAGAATATGCAAGCC | 73 | A | 88 |
| 1121629 | N/A | N/A | 13461 | 13476 | TTCCATAAGTTCCTGG | 79 | A | 89 |
| 1091564 | 273 | 288 | 13967 | 13982 | GCATTTCAATGGTTGA | 76 | B | 90 |
| 1091599 | 561 | 576 | 14255 | 14270 | CATGTTTACAAGATCC | 33 | B | 91 |
| 1121325 | 20 | 35 | 3282 | 3297 | ATGGGAACAGTTGCAG | 66 | B | 92 |
| 1121329 | 26 | 41 | 3288 | 3303 | CAGTTTATGGGAACAG | 60 | B | 93 |
| 1121333 | 75 | 90 | 3337 | 3352 | TATGAAGTCTTACGGG | 69 | B | 94 |
| 1121337 | 96 | 111 | 3358 | 3373 | ACAGTATAGAGTATTG | 77† | B | 95 |
| 1121341 | 128 | 143 | N/A | N/A | TCTTTTAGGTAGCCTT | 56† | B | 96 |
| 1121345 | 186 | 201 | 13880 | 13895 | GTTTTAAGTGGTCGAG | 50† | B | 97 |
| 1121349 | 230 | 245 | 13924 | 13939 | GTATTGGACTTTCTCC | 38† | B | 98 |
| 1121352 | 243 | 258 | 13937 | 13952 | CTGAGCGAGTGAGGTA | 34 | B | 99 |
| 1121356 | 247 | 262 | 13941 | 13956 | ATAGCTGAGCGAGTGA | 35 | B | 100 |
| 1121360 | 251 | 266 | 13945 | 13960 | TCTTATAGCTGAGCGA | 67 | B | 101 |
| 1121364 | 260 | 275 | 13954 | 13969 | TGAGGCTCTTCTTATA | 40 | B | 102 |
| 1121368 | 265 | 280 | 13959 | 13974 | ATGGTTGAGGCTCTTC | 49 | B | 103 |
| 1121372 | 269 | 284 | 13963 | 13978 | TTCAATGGTTGAGGCT | 71 | B | 104 |
| 1121379 | 344 | 359 | 14038 | 14053 | CAGCAAGAGACATATT | 53 | B | 105 |
| 1121383 | 365 | 380 | 14059 | 14074 | AAGCATCACGATGATA | 52 | B | 106 |
| 1121387 | 391 | 406 | 14085 | 14100 | CTAGAGGTTGTAGCAG | 64 | B | 107 |
| 1121391 | 406 | 421 | 14100 | 14115 | TGGCAAGCTGCAGATC | 17 | B | 108 |
| 1121398 | 816 | 831 | 14510 | 14525 | TGATACTTGGTGAAGA | 46 | B | 109 |
| 1121402 | 915 | 930 | 14609 | 14624 | TTCTGATAGTTACTAC | 25 | B | 110 |
| 1121406 | 1016 | 1031 | 14710 | 14725 | ATGTAAGAGTATGGCC | 60 | B | 111 |
| 1121410 | 1069 | 1084 | 14763 | 14778 | ATGTACTAGAATTCTG | 33 | B | 112 |
| 1121414 | 1133 | 1148 | 14827 | 14842 | CATATTAACCACCAGT | 38 | B | 113 |
| 1121418 | 1149 | 1164 | 14843 | 14858 | ACTAATCTCACTGTCA | 56 | B | 114 |
| 1121422 | 1162 | 1177 | 14856 | 14871 | TATTAGTGATATGACT | 85 | B | 115 |
| 1121426 | 1169 | 1184 | 14863 | 14878 | GTTAGTATATTAGTGA | 60 | B | 116 |
| 1121430 | 1211 | 1226 | 14905 | 14920 | GATAATTCACTACAGT | 47 | B | 117 |

TABLE 1-continued

Reduction of PLN RNA by 3-10-3 cEt modified oligonucleotides with uniform phosphorothioate internucleoside linkages at a concentration of 5000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121434 | 1230 | 1245 | 14924 | 14939 | GCTAGGTAACTCTAGC | 109 | B | 118 |
| 1121438 | 1243 | 1258 | 14937 | 14952 | TATAGTATGGTAAGCT | 50 | B | 119 |
| 1121442 | 1248 | 1263 | 14942 | 14957 | AAAGATATAGTATGGT | 38 | B | 120 |
| 1121446 | 1319 | 1334 | 15013 | 15028 | GCATTGGATGTTAGGC | 40 | B | 121 |
| 1121450 | 1459 | 1474 | 15153 | 15168 | GTAATAGATGGGCCAA | 45 | B | 122 |
| 1121454 | 1468 | 1483 | 15162 | 15177 | GCTGTAGATGTAATAG | 43 | B | 123 |
| 1121458 | 1511 | 1526 | 15205 | 15220 | CCCACGAATTGTCAGC | 33 | B | 124 |
| 1121462 | 1522 | 1537 | 15216 | 15231 | GATTTTGCGGACCCAC | 34 | B | 125 |
| 1121466 | 1535 | 1550 | 15229 | 15244 | ATTAGGTAGTTAAGAT | 52 | B | 126 |
| 1121470 | 1540 | 1555 | 15234 | 15249 | AGGCTATTAGGTAGTT | 35 | B | 127 |
| 1121474 | 1562 | 1577 | 15256 | 15271 | AGTAAGGTTTATGGTC | 29 | B | 128 |
| 1121478 | 1608 | 1623 | 15302 | 15317 | TACATATAACACGCAA | 51 | B | 129 |
| 1121482 | 1812 | 1827 | 15506 | 15521 | CCTAAGACAAGACTGC | 65 | B | 130 |
| 1121486 | 1862 | 1877 | 15556 | 15571 | TTGCAAGGGTCCACTT | 73 | B | 131 |
| 1121490 | 1901 | 1916 | 15595 | 15610 | ATCCTATTACAGTTGA | 49 | B | 132 |
| 1121494 | 1964 | 1979 | 15658 | 15673 | CAGTAGAGTGGACTGC | 89 | B | 133 |
| 1121498 | 1973 | 1988 | 15667 | 15682 | AATTTAGCTCAGTAGA | 49 | B | 134 |
| 1121502 | 2064 | 2079 | 15758 | 15773 | GAGTTATTGGAAGATG | 60 | B | 135 |
| 1121506 | 2175 | 2190 | 15869 | 15884 | GCAGTATAGGTGTAAA | 44 | B | 136 |
| 1121510 | 2217 | 2232 | 15911 | 15926 | TTAGTAACATGTCTTC | 51 | B | 137 |
| 1121514 | 2257 | 2272 | 15951 | 15966 | GGTTAATTACACATCC | 57 | B | 138 |
| 1121518 | 2286 | 2301 | 15980 | 15995 | TCTTTTAGTAACCATG | 45 | B | 139 |
| 1121522 | 2333 | 2348 | 16027 | 16042 | TAGCAACACTTGTGTA | 62 | B | 140 |
| 1121526 | 2342 | 2357 | 16036 | 16051 | CTATTGAGTTAGCAAC | 86 | B | 141 |
| 1121530 | 2386 | 2401 | 16080 | 16095 | TAGTATCTCTCATGGG | 86 | B | 142 |
| 1121534 | 2554 | 2569 | 16248 | 16263 | GTATTGGTAATTTACT | 110 | B | 143 |
| 1121538 | 2635 | 2650 | 16329 | 16344 | TTGTAACAAACAGTGT | 59 | B | 144 |
| 1121542 | 2923 | 2938 | 16617 | 16632 | AGGCAACATTAAGCAT | 65 | B | 145 |
| 1121558 | N/A | N/A | 3851 | 3866 | GCTGATAATGTGCATG | 40 | B | 146 |
| 1121562 | N/A | N/A | 4617 | 4632 | TAGGATACCTCAGTGG | 50 | B | 147 |
| 1121566 | N/A | N/A | 4987 | 5002 | ATACTTAACTTGCACC | 80 | B | 148 |
| 1121570 | N/A | N/A | 5679 | 5694 | TCAGTATATAGAGGAT | 47 | B | 149 |
| 1121574 | N/A | N/A | 6186 | 6201 | AGAATTACTCTGGGTA | 43 | B | 150 |
| 1121578 | N/A | N/A | 6804 | 6819 | AGTTACTTTGTGGTAG | 65 | B | 151 |
| 1121582 | N/A | N/A | 7128 | 7143 | GTAATATCTAAGGCTA | 46 | B | 152 |

TABLE 1-continued

Reduction of PLN RNA by 3-10-3 cEt modified oligonucleotides with uniform phosphorothioate internucleoside linkages at a concentration of 5000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121586 | N/A | N/A | 7520 | 7535 | TACTATATATCAACTC | 73 | B | 153 |
| 1121590 | N/A | N/A | 8495 | 8510 | TAATTTATTGGGCTCA | 47 | B | 154 |
| 1121594 | N/A | N/A | 8962 | 8977 | AGATTAACTAGTTCTA | 124 | B | 155 |
| 1121598 | N/A | N/A | 9641 | 9656 | GAGGATATCTGTCAGA | 67 | B | 156 |
| 1121602 | N/A | N/A | 9697 | 9712 | GTGGAATTGGTTGTCA | 59 | B | 157 |
| 1121606 | N/A | N/A | 9939 | 9954 | AAGCATATACAGGAGT | 63 | B | 158 |
| 1121610 | N/A | N/A | 11369 | 11384 | TCATAATATTGGTCTG | 58 | B | 159 |
| 1121614 | N/A | N/A | 11678 | 11693 | ATTACTACCTTACCCC | 68 | B | 160 |
| 1121618 | N/A | N/A | 11741 | 11756 | AGTAATTAACTGCCAG | 59 | B | 161 |
| 1121622 | N/A | N/A | 12016 | 12031 | TCCTATTTACAGACTT | 63 | B | 162 |
| 1121626 | N/A | N/A | 12723 | 12738 | TTCGATAATAATTTGT | 79 | B | 163 |
| 1121630 | N/A | N/A | 13484 | 13499 | GTATTGGAGTAATCCT | 79 | B | 164 |
| 1121326 | 22 | 37 | 3284 | 3299 | TTATGGGAACAGTTGC | 93 | C | 165 |
| 1121330 | 65 | 80 | 3327 | 3342 | TACGGGTGTTTAGCTG | 59 | C | 166 |
| 1121334 | 76 | 91 | 3338 | 3353 | GTATGAAGTCTTACGG | 46 | C | 167 |
| 1121338 | 122 | 137 | N/A | N/A | AGGTAGCCTTGGCAGC | 43† | C | 168 |
| 1121342 | 129 | 144 | 13823 | 13838 | TTCTTTTAGGTAGCCT | 67† | C | 169 |
| 1121346 | 187 | 202 | 13881 | 13896 | AGTTTTAAGTGGTCGA | 48† | C | 170 |
| 1121350 | 233 | 248 | 13927 | 13942 | GAGGTATTGGACTTTC | 52† | C | 171 |
| 1121353 | 244 | 259 | 13938 | 13953 | GCTGAGCGAGTGAGGT | 50 | C | 172 |
| 1121357 | 248 | 263 | 13942 | 13957 | TATAGCTGAGCGAGTG | 95 | C | 173 |
| 1121361 | 252 | 267 | 13946 | 13961 | TTCTTATAGCTGAGCG | 76 | C | 174 |
| 1121365 | 262 | 277 | 13956 | 13971 | GTTGAGGCTCTTCTTA | 57 | C | 175 |
| 1121369 | 266 | 281 | 13960 | 13975 | AATGGTTGAGGCTCTT | 70 | C | 176 |
| 1121373 | 270 | 285 | 13964 | 13979 | TTTCAATGGTTGAGGC | 42 | C | 177 |
| 1121376 | 274 | 289 | 13968 | 13983 | GGCATTTCAATGGTTG | 24 | C | 178 |
| 1121380 | 356 | 371 | 14050 | 14065 | GATGATACAGATCAGC | 91 | C | 179 |
| 1121384 | 369 | 384 | 14063 | 14078 | AGAGAAGCATCACGAT | 52 | C | 180 |
| 1121388 | 393 | 408 | 14087 | 14102 | ATCTAGAGGTTGTAGC | 80 | C | 181 |
| 1121392 | 473 | 488 | 14167 | 14182 | TCAGGAAGTGGTCTGT | 81 | C | 182 |
| 1121395 | 653 | 668 | 14347 | 14362 | TGGGATAGAAATTTGT | 90 | C | 183 |
| 1121399 | 819 | 834 | 14513 | 14528 | CTTTGATACTTGGTGA | 72 | C | 184 |
| 1121403 | 992 | 1007 | 14686 | 14701 | CCATACTTGATTCTCA | 28 | C | 185 |
| 1121407 | 1017 | 1032 | 14711 | 14726 | TATGTAAGAGTATGGC | 37 | C | 186 |
| 1121411 | 1075 | 1090 | 14769 | 14784 | ACCTACATGTACTAGA | 71 | C | 187 |

TABLE 1-continued

Reduction of PLN RNA by 3-10-3 cEt modified oligonucleotides with uniform phosphorothioate internucleoside linkages at a concentration of 5000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121415 | 1134 | 1149 | 14828 | 14843 | ACATATTAACCACCAG | 31 | C | 188 |
| 1121419 | 1152 | 1167 | 14846 | 14861 | ATGACTAATCTCACTG | 103 | C | 189 |
| 1121423 | 1163 | 1178 | 14857 | 14872 | ATATTAGTGATATGAC | 147 | C | 190 |
| 1121427 | 1183 | 1198 | 14877 | 14892 | GATTAGATTCTGTTGT | 62 | C | 191 |
| 1121431 | 1221 | 1236 | 14915 | 14930 | CTCTAGCTCAGATAAT | 90 | C | 192 |
| 1121435 | 1231 | 1246 | 14925 | 14940 | AGCTAGGTAACTCTAG | 92 | C | 193 |
| 1121439 | 1244 | 1259 | 14938 | 14953 | ATATAGTATGGTAAGC | 90 | C | 194 |
| 1121443 | 1267 | 1282 | 14961 | 14976 | CTTAAGGTTTCATGAT | 74 | C | 195 |
| 1121447 | 1321 | 1336 | 15015 | 15030 | CTGCATTGGATGTTAG | 82 | C | 196 |
| 1121451 | 1460 | 1475 | 15154 | 15169 | TGTAATAGATGGGCCA | 60 | C | 197 |
| 1121455 | 1506 | 1521 | 15200 | 15215 | GAATTGTCAGCTCCCC | 29 | C | 198 |
| 1121459 | 1512 | 1527 | 15206 | 15221 | ACCCACGAATTGTCAG | 76 | C | 199 |
| 1121463 | 1525 | 1540 | 15219 | 15234 | TAAGATTTTGCGGACC | 79 | C | 200 |
| 1121467 | 1536 | 1551 | 15230 | 15245 | TATTAGGTAGTTAAGA | 108 | C | 201 |
| 1121471 | 1556 | 1571 | 15250 | 15265 | GTTTATGGTCAATAGT | 144 | C | 202 |
| 1121475 | 1565 | 1580 | 15259 | 15274 | ATCAGTAAGGTTTATG | 58 | C | 203 |
| 1121479 | 1626 | 1641 | 15320 | 15335 | TAGGAATATAGTGTAT | 52 | C | 204 |
| 1121483 | 1813 | 1828 | 15507 | 15522 | CCCTAAGACAAGACTG | 78 | C | 205 |
| 1121487 | 1865 | 1880 | 15559 | 15574 | GAATTGCAAGGGTCCA | 64 | C | 206 |
| 1121491 | 1907 | 1922 | 15601 | 15616 | AGCTATATCCTATTAC | 87 | C | 207 |
| 1121495 | 1965 | 1980 | 15659 | 15674 | TCAGTAGAGTGGACTG | 76 | C | 208 |
| 1121499 | 1974 | 1989 | 15668 | 15683 | TAATTTAGCTCAGTAG | 69 | C | 209 |
| 1121503 | 2094 | 2109 | 15788 | 15803 | CAGCACTCAATTTTAC | 72 | C | 210 |
| 1121507 | 2182 | 2197 | 15876 | 15891 | GGATTATGCAGTATAG | 48 | C | 211 |
| 1121511 | 2218 | 2233 | 15912 | 15927 | ATTAGTAACATGTCTT | 88 | C | 212 |
| 1121515 | 2261 | 2276 | 15955 | 15970 | ATATGGTTAATTACAC | 92 | C | 213 |
| 1121519 | 2314 | 2329 | 16008 | 16023 | AACCAAGGTCAATATT | 102 | C | 214 |
| 1121523 | 2336 | 2351 | 16030 | 16045 | AGTTAGCAACACTTGT | 85 | C | 215 |
| 1121527 | 2343 | 2358 | 16037 | 16052 | ACTATTGAGTTAGCAA | 80 | C | 216 |
| 1121531 | 2423 | 2438 | 16117 | 16132 | GATATCCCTGAACCAA | 85 | C | 217 |
| 1121535 | 2572 | 2587 | 16266 | 16281 | AGACTAGGGATACTTT | 64 | C | 218 |
| 1121539 | 2863 | 2878 | 16557 | 16572 | TTCTATAGTAGAACAT | 103 | C | 219 |
| 1121543 | 2982 | 2997 | 16676 | 16691 | ATATAGTGATTCTGAT | 79 | C | 220 |
| 1121555 | N/A | N/A | 3408 | 3423 | ATTACCAAAGTCAGCG | 52 | C | 221 |
| 1121559 | N/A | N/A | 4209 | 4224 | AGGCATTAATAGGCAG | 43 | C | 222 |

TABLE 1-continued

Reduction of PLN RNA by 3-10-3 cEt modified oligonucleotides with uniform phosphorothioate internucleoside linkages at a concentration of 5000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121563 | N/A | N/A | 4623 | 4638 | CACAATTAGGATACCT | 69 | C | 223 |
| 1121567 | N/A | N/A | 5160 | 5175 | GAAATGATAGTGCTGT | 65 | C | 224 |
| 1121571 | N/A | N/A | 6117 | 6132 | AGTATCGAAATGTGAT | 88 | C | 225 |
| 1121575 | N/A | N/A | 6353 | 6368 | CCTATTAATGTGAGTG | 75 | C | 226 |
| 1121579 | N/A | N/A | 6898 | 6913 | TTTACGATGAATCTGT | 91 | C | 227 |
| 1121583 | N/A | N/A | 7129 | 7144 | AGTAATATCTAAGGCT | 68 | C | 228 |
| 1121587 | N/A | N/A | 8058 | 8073 | CTTGTATATGGCCTAA | 66 | C | 229 |
| 1121591 | N/A | N/A | 8496 | 8511 | TTAATTTATTGGGCTC | 71 | C | 230 |
| 1121595 | N/A | N/A | 8963 | 8978 | CAGATTAACTAGTTCT | 111 | C | 231 |
| 1121599 | N/A | N/A | 9642 | 9657 | TGAGGATATCTGTCAG | 102 | C | 232 |
| 1121603 | N/A | N/A | 9710 | 9725 | ATTAGTTATTAAGGTG | 102 | C | 233 |
| 1121607 | N/A | N/A | 10489 | 10504 | TTATTGTAGATCTAGT | 74 | C | 234 |
| 1121611 | N/A | N/A | 11411 | 11426 | TATAGTAGACTGGGCA | 59 | C | 235 |
| 1121615 | N/A | N/A | 11681 | 11696 | CATATTACTACCTTAC | 85 | C | 236 |
| 1121619 | N/A | N/A | 11799 | 11814 | CAGTATACTTATGTGT | 82 | C | 237 |
| 1121623 | N/A | N/A | 12307 | 12322 | GTAATTGGTTTGATCA | 68 | C | 238 |
| 1121627 | N/A | N/A | 12724 | 12739 | ATTCGATAATAATTTG | 83 | C | 239 |
| 1121631 | N/A | N/A | 13529 | 13544 | AGTAGTAACTTTAGTC | 56 | C | 240 |
| 1091555 | 236 | 251 | 13930 | 13945 | AGTGAGGTATTGGACT | 88† | D | 241 |
| 1121327 | 24 | 39 | 3286 | 3301 | GTTTATGGGAACAGTT | 94 | D | 242 |
| 1121331 | 67 | 82 | 3329 | 3344 | CTTACGGGTGTTTAGC | 77 | D | 243 |
| 1121335 | 93 | 108 | 3355 | 3370 | GTATAGAGTATTGTGT | 58 | D | 244 |
| 1121339 | 125 | 140 | N/A | N/A | TTTAGGTAGCCTTGGC | 50† | D | 245 |
| 1121343 | 178 | 193 | 13872 | 13887 | TGGTCGAGAGAAAGAT | 63† | D | 246 |
| 1121347 | 188 | 203 | 13882 | 13897 | AAGTTTTAAGTGGTCG | 58† | D | 247 |
| 1121354 | 245 | 260 | 13939 | 13954 | AGCTGAGCGAGTGAGG | 56 | D | 248 |
| 1121358 | 249 | 264 | 13943 | 13958 | TTATAGCTGAGCGAGT | 72 | D | 249 |
| 1121362 | 258 | 273 | 13952 | 13967 | AGGCTCTTCTTATAGC | 87 | D | 250 |
| 1121366 | 263 | 278 | 13957 | 13972 | GGTTGAGGCTCTTCTT | 46 | D | 251 |
| 1121370 | 267 | 282 | 13961 | 13976 | CAATGGTTGAGGCTCT | 52 | D | 252 |
| 1121374 | 271 | 286 | 13965 | 13980 | ATTTCAATGGTTGAGG | 38 | D | 253 |
| 1121377 | 275 | 290 | 13969 | 13984 | AGGCATTTCAATGGTT | 57 | D | 254 |
| 1121381 | 360 | 375 | 14054 | 14069 | TCACGATGATACAGAT | 84 | D | 255 |
| 1121385 | 370 | 385 | 14064 | 14079 | CAGAGAAGCATCACGA | 37 | D | 256 |
| 1121389 | 394 | 409 | 14088 | 14103 | GATCTAGAGGTTGTAG | 106 | D | 257 |

TABLE 1-continued

Reduction of PLN RNA by 3-10-3 cEt modified oligonucleotides with uniform phosphorothioate internucleoside linkages at a concentration of 5000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121393 | 556 | 571 | 14250 | 14265 | TTACAAGATCCAACAG | 86 | D | 258 |
| 1121396 | 709 | 724 | 14403 | 14418 | GTGAACTTGTTGGCAG | 42 | D | 259 |
| 1121400 | 823 | 838 | 14517 | 14532 | ATTACTTTGATACTTG | 29 | D | 260 |
| 1121404 | 1013 | 1028 | 14707 | 14722 | TAAGAGTATGGCCTTA | 90 | D | 261 |
| 1121408 | 1018 | 1033 | 14712 | 14727 | TTATGTAAGAGTATGG | 62 | D | 262 |
| 1121412 | 1130 | 1145 | 14824 | 14839 | ATTAACCACCAGTTCT | 75 | D | 263 |
| 1121416 | 1135 | 1150 | 14829 | 14844 | CACATATTAACCACCA | 42 | D | 264 |
| 1121420 | 1155 | 1170 | 14849 | 14864 | GATATGACTAATCTCA | 68 | D | 265 |
| 1121424 | 1167 | 1182 | 14861 | 14876 | TAGTATATTAGTGATA | 96 | D | 266 |
| 1121428 | 1187 | 1202 | 14881 | 14896 | TGAAGATTAGATTCTG | 72 | D | 267 |
| 1121432 | 1227 | 1242 | 14921 | 14936 | AGGTAACTCTAGCTCA | 50 | D | 268 |
| 1121436 | 1239 | 1254 | 14933 | 14948 | GTATGGTAAGCTAGGT | 78 | D | 269 |
| 1121440 | 1246 | 1261 | 14940 | 14955 | AGATATAGTATGGTAA | 73 | D | 270 |
| 1121444 | 1275 | 1290 | 14969 | 14984 | TCTGAAGTCTTAAGGT | 55 | D | 271 |
| 1121448 | 1449 | 1464 | 15143 | 15158 | GGCCAACAAGTTCATT | 117 | D | 272 |
| 1121452 | 1461 | 1476 | 15155 | 15170 | ATGTAATAGATGGGCC | 102 | D | 273 |
| 1121456 | 1509 | 1524 | 15203 | 15218 | CACGAATTGTCAGCTC | 97 | D | 274 |
| 1121460 | 1517 | 1532 | 15211 | 15226 | TGCGGACCCACGAATT | 50 | D | 275 |
| 1121464 | 1526 | 1541 | 15220 | 15235 | TTAAGATTTTGCGGAC | 66 | D | 276 |
| 1121468 | 1538 | 1553 | 15232 | 15247 | GCTATTAGGTAGTTAA | 72 | D | 277 |
| 1121472 | 1558 | 1573 | 15252 | 15267 | AGGTTTATGGTCAATA | 30 | D | 278 |
| 1121476 | 1599 | 1614 | 15293 | 15308 | CACGCAAAATATGTGT | 108 | D | 279 |
| 1121480 | 1629 | 1644 | 15323 | 15338 | TTGTAGGAATATAGTG | 70 | D | 280 |
| 1121484 | 1814 | 1829 | 15508 | 15523 | CCCCTAAGACAAGACT | 77 | D | 281 |
| 1121488 | 1899 | 1914 | 15593 | 15608 | CCTATTACAGTTGACC | 98 | D | 282 |
| 1121492 | 1933 | 1948 | 15627 | 15642 | CATTTGGTTGATAGAG | 83 | D | 283 |
| 1121496 | 1966 | 1981 | 15660 | 15675 | CTCAGTAGAGTGGACT | 83 | D | 284 |
| 1121500 | 1979 | 1994 | 15673 | 15688 | ATCTATAATTTAGCTC | 70 | D | 285 |
| 1121504 | 2172 | 2187 | 15866 | 15881 | GTATAGGTGTAAACTA | 103 | D | 286 |
| 1121508 | 2184 | 2199 | 15878 | 15893 | TTGGATTATGCAGTAT | 76 | D | 287 |
| 1121512 | 2249 | 2264 | 15943 | 15958 | ACACATCCTCTACTCT | 125 | D | 288 |
| 1121516 | 2280 | 2295 | 15974 | 15989 | AGTAACCATGTTTTAG | 64 | D | 289 |
| 1121520 | 2316 | 2331 | 16010 | 16025 | GAAACCAAGGTCAATA | 49 | D | 290 |
| 1121524 | 2338 | 2353 | 16032 | 16047 | TGAGTTAGCAACACTT | 56 | D | 291 |
| 1121528 | 2344 | 2359 | 16038 | 16053 | CACTATTGAGTTAGCA | 91 | D | 292 |

TABLE 1-continued

Reduction of PLN RNA by 3-10-3 cEt modified oligonucleotides with uniform phosphorothioate internucleoside linkages at a concentration of 5000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121532 | 2424 | 2439 | 16118 | 16133 | AGATATCCCTGAACCA | 81 | D | 293 |
| 1121536 | 2574 | 2589 | 16268 | 16283 | TAAGACTAGGGATACT | 90 | D | 294 |
| 1121540 | 2888 | 2903 | 16582 | 16597 | CCCTGTAAATTAAGAT | 107 | D | 295 |
| 1121556 | N/A | N/A | 3617 | 3632 | ACCAGTAACCAGGATC | 37 | D | 296 |
| 1121560 | N/A | N/A | 4348 | 4363 | ATAGGGTAGAATTCAA | 88 | D | 297 |
| 1121564 | N/A | N/A | 4961 | 4976 | GATGAACTAGTTGGGA | 70 | D | 298 |
| 1121568 | N/A | N/A | 5533 | 5548 | ATAATTAAGAGGACCA | 78 | D | 299 |
| 1121572 | N/A | N/A | 6125 | 6140 | TAGAATAAAGTATCGA | 109 | D | 300 |
| 1121576 | N/A | N/A | 6408 | 6423 | TAGTATTGAGAAAGTC | 34 | D | 301 |
| 1121580 | N/A | N/A | 6901 | 6916 | AGATTTACGATGAATC | 95 | D | 302 |
| 1121584 | N/A | N/A | 7425 | 7440 | CTCAATAGTCTTCTGA | 70 | D | 303 |
| 1121588 | N/A | N/A | 8182 | 8197 | CTGTTTAATAGAGTAC | 121 | D | 304 |
| 1121592 | N/A | N/A | 8827 | 8842 | AGTATTAACCTGAACT | 101 | D | 305 |
| 1121596 | N/A | N/A | 8964 | 8979 | ACAGATTAACTAGTTC | 99 | D | 306 |
| 1121600 | N/A | N/A | 9649 | 9664 | ATCTATATGAGGATAT | 100 | D | 307 |
| 1121604 | N/A | N/A | 9937 | 9952 | GCATATACAGGAGTCA | 97 | D | 308 |
| 1121608 | N/A | N/A | 10490 | 10505 | CTTATTGTAGATCTAG | 67 | D | 309 |
| 1121612 | N/A | N/A | 11526 | 11541 | GTAAGTATCAGGCATG | 62 | D | 310 |
| 1121616 | N/A | N/A | 11682 | 11697 | ACATATTACTACCTTA | 88 | D | 311 |
| 1121620 | N/A | N/A | 11833 | 11848 | CGTTATTAACACTTGG | 50 | D | 312 |
| 1121624 | N/A | N/A | 12473 | 12488 | GAGAATATGCAAGCCC | 58 | D | 313 |
| 1121628 | N/A | N/A | 12929 | 12944 | GTATTTGGTGAATCAG | 61 | D | 314 |
| 1121632 | N/A | N/A | 13770 | 13785 | GTAACCTATCCTCAGA | 126 | D | 315 |

Example 2: Effect of 3-10-3 cEt Uniform Phosphorothioate Modified Oligonucleotides on Human PLN RNA In Vitro, Single Dose Modified oligonucleotides complementary to human PLN nucleic acid were designed and tested for their single dose effects on PLN RNA in vitro. The modified oligonucleotides were tested in a series of experiments that had the same culture conditions.

The modified oligonucleotides in the table below are 3-10-3 cEt modified oligonucleotides with uniform phosphorothioate internucleoside linkages. The modified oligonucleotides are 16 nucleosides in length, wherein the central gap segment consists of ten 2'-β-D-deoxynucleosides, and wherein the 5' and 3' wing segments each consist of three cEt nucleosides. The sugar motif for the modified oligonucleotides is (from 5' to 3'): kkkddddddddddkkk; wherein each "d" represents a 2'-β-D-deoxyribosyl sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

"Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the table below is 100% complementary to SEQ ID NO: 1 (described herein above), to SEQ ID NO: 2 (described herein above), or to both. "N/A" indicates that the modified oligonucleotide is not 100% complementary to that particular target nucleic acid sequence.

Cultured iCell® cardiomyocytes[2] (FujiFilm Cellular Dynamics, Inc.; Catalog No: R1017) were treated with modified oligonucleotide at a concentration of 6000 nM by free uptake at a density of 8,000 cells per well. After a treatment period of approximately 72 hours, total RNA was isolated from the cells and PLN RNA levels were measured by quantitative real-time RTPCR. PLN RNA levels were measured by human primer-probe set RTS40402 (described herein above). PLN RNA levels were normalized to total RNA content, as measured by RIBOGREEN® Reduction of PLN RNA is presented in the table below as percent PLN RNA relative to the amount in untreated control cells (% UTC). The values marked with a "T" indicate that the modified oligonucleotide is complementary to the amplicon region of the primer probe set. Additional assays may be used to measure the potency and efficacy of the modified oligonucleotides complementary to the amplicon region. N.D. in the table below refers to instances where the value was Not Defined.

Each separate experimental analysis described in this example is identified by a letter ID in the table column below labeled "AID" (Analysis ID).

TABLE 2

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1091564 | 273 | 288 | 13967 | 13982 | GCATTTCAATGGTTGA | 32 | E | 90 |
| 1121455 | 1506 | 1521 | 15200 | 15215 | GAATTGTCAGCTCCCC | 9 | E | 198 |
| 1342182 | N/A | N/A | 6338 | 6353 | GAGTTAGTCAACCTTT | 38 | E | 316 |
| 1342231 | N/A | N/A | 8336 | 8351 | GAACAGCAGAATCCTA | 78 | E | 317 |
| 1342234 | N/A | N/A | 3396 | 3411 | AGCGAAATCTGTTTCT | 73 | E | 318 |
| 1342236 | N/A | N/A | 9587 | 9602 | CTAGACTGATAGTTTC | 60 | E | 319 |
| 1342254 | 828 | 843 | 14522 | 14537 | GTGTTATTACTTTGAT | 16 | E | 320 |
| 1342267 | N/A | N/A | 11989 | 12004 | TAGTAGTTTCCATCAT | 49 | E | 321 |
| 1342283 | N/A | N/A | 8061 | 8076 | GAACTTGTATATGGCC | 52 | E | 322 |
| 1342301 | 1100 | 1115 | 14794 | 14809 | ATGTCTTAGAACAGAT | 41 | E | 323 |
| 1342366 | N/A | N/A | 5401 | 5416 | GTAACTAGACTTTAGG | 35 | F | 324 |
| 1342380 | N/A | N/A | 6828 | 6843 | ACTAAACTTGGACATT | 63 | E | 325 |
| 1342397 | N/A | N/A | 11685 | 11700 | TCAACATATTACTACC | 61 | E | 326 |
| 1342398 | N/A | N/A | 12076 | 12091 | CTGAAGACTGTCAAGC | 34 | E | 327 |
| 1342445 | 353 | 368 | 14047 | 14062 | GATACAGATCAGCAAG | 42 | E | 328 |
| 1342456 | N/A | N/A | 6070 | 6085 | GGATTTTAGGTATCAG | 28 | E | 329 |
| 1342468 | N/A | N/A | 6157 | 6172 | TGTACAAAGAGACTAC | 77 | F | 330 |
| 1342474 | N/A | N/A | 4349 | 4364 | AATAGGGTAGAATTCA | 59 | E | 331 |
| 1342485 | N/A | N/A | 6644 | 6659 | GTTAAAGCTCTGTCTT | 38 | E | 332 |
| 1342505 | N/A | N/A | 5676 | 5691 | GTATATAGAGGATGTG | 42 | E | 333 |
| 1342514 | 1205 | 1220 | 14899 | 14914 | TCACTACAGTGCCTTA | 23 | E | 334 |
| 1342521 | 1541 | 1556 | 15235 | 15250 | TAGGCTATTAGGTAGT | 29 | E | 335 |
| 1342523 | 644 | 659 | 14338 | 14353 | AATTTGTGAGCCATGT | 35 | E | 336 |
| 1342541 | N/A | N/A | 13490 | 13505 | CTACAAGTATTGGAGT | 86 | E | 337 |
| 1342551 | 1270 | 1285 | 14964 | 14979 | AGTCTTAAGGTTTCAT | 12 | E | 338 |
| 1342552 | 1507 | 1522 | 15201 | 15216 | CGAATTGTCAGCTCCC | 19 | E | 339 |
| 1342558 | N/A | N/A | 12368 | 12383 | GGTTATTCTTTTGGGT | 52 | E | 340 |
| 1342566 | N/A | N/A | 6967 | 6982 | GCCATAAGTGAATGTG | 84 | E | 341 |
| 1342576 | N/A | N/A | 7463 | 7478 | GCAATGTAATATCAGA | 16 | E | 342 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342583 | N/A | N/A | 7344 | 7359 | GAGCATTAATCTCCAT | 41 | E | 343 |
| 1342593 | N/A | N/A | 4988 | 5003 | AATACTTAACTTGCAC | 66 | E | 344 |
| 1342612 | N/A | N/A | 3616 | 3631 | CCAGTAACCAGGATCA | 57 | E | 345 |
| 1342620 | N/A | N/A | 12282 | 12297 | TTAATAGCTCCAGAGC | 93 | E | 346 |
| 1342628 | N/A | N/A | 5927 | 5942 | AATAACTAAGGGCATC | 70 | E | 347 |
| 1342631 | N/A | N/A | 12818 | 12833 | AACAATTCAAATACGG | 44 | E | 348 |
| 1342648 | 436 | 451 | 14130 | 14145 | CTGCATGGGATGACAG | 31 | E | 349 |
| 1342655 | N/A | N/A | 12550 | 12565 | ACAACTTAAACATGCC | 69 | E | 350 |
| 1342688 | 183 | 198 | 13877 | 13892 | TTAAGTGGTCGAGAGA | 9† | E | 351 |
| 1342697 | N/A | N/A | 13818 | 13833 | TTAGGTAGCCTGGAAT | 87† | E | 352 |
| 1342716 | N/A | N/A | 7562 | 7577 | CTAATGTCATATACCA | 26 | E | 353 |
| 1342722 | N/A | N/A | 3849 | 3864 | TGATAATGTGCATGTT | 32 | E | 354 |
| 1342749 | 918 | 933 | 14612 | 14627 | AGATTCTGATAGTTAC | 8 | E | 355 |
| 1342753 | N/A | N/A | 9443 | 9458 | AATAATGCTGTGGGCA | 87 | E | 356 |
| 1342765 | N/A | N/A | 10719 | 10734 | TACAACAAGCTCCCCA | 94 | E | 357 |
| 1342767 | 529 | 544 | 14223 | 14238 | TGGTAACAATAAGTTT | 64 | E | 358 |
| 1342793 | N/A | N/A | 7859 | 7874 | TAGAAATGCCAGACTC | 52 | E | 359 |
| 1342808 | 1153 | 1168 | 14847 | 14862 | TATGACTAATCTCACT | 57 | E | 360 |
| 1342862 | 995 | 1010 | 14689 | 14704 | TTTCCATACTTGATTC | 48 | E | 361 |
| 1342865 | N/A | N/A | 11412 | 11427 | ATATAGTAGACTGGGC | 42 | E | 362 |
| 1342867 | N/A | N/A | 7108 | 7123 | CTGATATACTCTAGGA | 28 | E | 363 |
| 1342894 | N/A | N/A | 5532 | 5547 | TAATTAAGAGGACCAA | 85 | E | 364 |
| 1342904 | N/A | N/A | 4825 | 4840 | CAGAAGTATGTGTACT | 44 | E | 365 |
| 1342913 | 718 | 733 | 14412 | 14427 | ATATATGAAGTGAACT | 96 | E | 366 |
| 1342943 | N/A | N/A | 10106 | 10121 | GCAGAATACAGTTAAG | 33 | E | 367 |
| 1342945 | 2071 | 2086 | 15765 | 15780 | GTTTTATGAGTTATTG | 36 | E | 368 |
| 1342962 | 2174 | 2189 | 15868 | 15883 | CAGTATAGGTGTAAAC | 67 | E | 369 |
| 1342966 | 392 | 407 | 14086 | 14101 | TCTAGAGGTTGTAGCA | 52 | E | 370 |
| 1342973 | N/A | N/A | 4945 | 4960 | CACAATGTATGGTACT | 42 | E | 371 |
| 1342984 | 1981 | 1996 | 15675 | 15690 | GGATCTATAATTTAGC | 60 | E | 372 |
| 1343017 | 1935 | 1950 | 15629 | 15644 | ACCATTTGGTTGATAG | 69 | E | 373 |
| 1343050 | N/A | N/A | 4695 | 4710 | AACATAAGACACCTAC | 58 | E | 374 |
| 1343060 | N/A | N/A | 8573 | 8588 | AGTTATTTGTAACTAC | 90 | F | 375 |
| 1343062 | N/A | N/A | 11525 | 11540 | TAAGTATCAGGCATGA | 78 | E | 376 |
| 1343067 | N/A | N/A | 4204 | 4219 | TTAATAGGCAGAAATC | 58 | E | 377 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343068 | N/A | N/A | 3803 | 3818 | ATGTAAATAGCTCAGT | 44 | E | 378 |
| 1343076 | N/A | N/A | 11116 | 11131 | CGTAAAGACATACACC | 106 | E | 379 |
| 1343099 | N/A | N/A | 6468 | 6483 | CTTAACCCTGTAGGAG | 76 | E | 380 |
| 1343101 | N/A | N/A | 9709 | 9724 | TTAGTTATTAAGGTGG | 56 | E | 381 |
| 1343103 | 1627 | 1642 | 15321 | 15336 | GTAGGAATATAGTGTA | 9 | E | 382 |
| 1343109 | 1072 | 1087 | 14766 | 14781 | TACATGTACTAGAATT | 85 | E | 383 |
| 1343131 | 1864 | 1879 | 15558 | 15573 | AATTGCAAGGGTCCAC | 35 | E | 384 |
| 1343136 | N/A | N/A | 6904 | 6919 | ATTAGATTTACGATGA | 74 | E | 385 |
| 1343157 | 1448 | 1463 | 15142 | 15157 | GCCAACAAGTTCATTT | 25 | F | 386 |
| 1343189 | N/A | N/A | 8774 | 8789 | ACAGAGATATGCCCTA | 31 | E | 387 |
| 1343195 | N/A | N/A | 4619 | 4634 | ATTAGGATACCTCAGT | 66 | E | 388 |
| 1343196 | 1236 | 1251 | 14930 | 14945 | TGGTAAGCTAGGTAAC | 44 | E | 389 |
| 1343216 | 2875 | 2890 | 16569 | 16584 | GATAAGAACTTATTCT | 40 | E | 390 |
| 1343228 | 2279 | 2294 | 15973 | 15988 | GTAACCATGTTTTAGA | 39 | E | 391 |
| 1121455 | 1506 | 1521 | 15200 | 15215 | GAATTGTCAGCTCCCC | 17 | F | 198 |
| 1342169 | 1320 | 1335 | 15014 | 15029 | TGCATTGGATGTTAGG | 25 | F | 392 |
| 1342192 | N/A | N/A | 3395 | 3410 | GCGAAATCTGTTTCTT | 81 | F | 393 |
| 1342204 | 1099 | 1114 | 14793 | 14808 | TGTCTTAGAACAGATT | 62 | F | 394 |
| 1342216 | N/A | N/A | 13489 | 13504 | TACAAGTATTGGAGTA | 87 | F | 395 |
| 1342271 | N/A | N/A | 3848 | 3863 | GATAATGTGCATGTTG | 29 | F | 396 |
| 1342273 | 1492 | 1507 | 15186 | 15201 | CCTAACCCCCATGTTC | 69 | F | 397 |
| 1342289 | N/A | N/A | 5400 | 5415 | TAACTAGACTTTAGGT | 53 | F | 398 |
| 1342291 | N/A | N/A | 10081 | 10096 | ATAATTAGACTTGGTA | 51 | F | 399 |
| 1342319 | N/A | N/A | 6966 | 6981 | CCATAAGTGAATGTGC | 27 | F | 400 |
| 1342335 | 1070 | 1085 | 14764 | 14779 | CATGTACTAGAATTCT | 35 | F | 401 |
| 1342345 | N/A | N/A | 12548 | 12563 | AACTTAAACATGCCAG | 58 | F | 402 |
| 1342352 | 2069 | 2084 | 15763 | 15778 | TTTATGAGTTATTGGA | 33 | F | 403 |
| 1342354 | N/A | N/A | 5675 | 5690 | TATATAGAGGATGTGC | 55 | F | 404 |
| 1342364 | 1204 | 1219 | 14898 | 14913 | CACTACAGTGCCTTAA | 41 | F | 405 |
| 1342377 | N/A | N/A | 11410 | 11425 | ATAGTAGACTGGGCAT | 54 | F | 406 |
| 1342389 | N/A | N/A | 4562 | 4577 | GCTTACAGAGTTACAA | 34 | F | 407 |
| 1342413 | N/A | N/A | 9708 | 9723 | TAGTTATTAAGGTGGA | 31 | F | 408 |
| 1342432 | N/A | N/A | 4694 | 4709 | ACATAAGACACCTACA | 64 | F | 409 |
| 1342447 | N/A | N/A | 6413 | 6428 | GGAGGTAGTATTGAGA | 69 | F | 410 |
| 1342463 | 826 | 841 | 14520 | 14535 | GTTATTACTTTGATAC | 57 | F | 411 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342494 | N/A | N/A | 7107 | 7122 | TGATATACTCTAGGAT | 79 | F | 412 |
| 1342499 | N/A | N/A | 7461 | 7476 | AATGTAATATCAGATG | 74 | F | 413 |
| 1342509 | N/A | N/A | 11524 | 11539 | AAGTATCAGGCATGAC | 64 | F | 414 |
| 1342531 | N/A | N/A | 6827 | 6842 | CTAAACTTGGACATTC | 68 | F | 415 |
| 1342537 | N/A | N/A | 4823 | 4838 | GAAGTATGTGTACTTT | 103 | F | 416 |
| 1342538 | 388 | 403 | 14082 | 14097 | GAGGTTGTAGCAGAAC | 51 | F | 417 |
| 1342549 | 1235 | 1250 | 14929 | 14944 | GGTAAGCTAGGTAACT | 55 | F | 418 |
| 1342595 | 1821 | 1836 | 15515 | 15530 | CCCCACACCCCTAAGA | 112 | F | 419 |
| 1342596 | N/A | N/A | 6069 | 6084 | GATTTTAGGTATCAGA | 47 | F | 420 |
| 1342603 | N/A | N/A | 6903 | 6918 | TTAGATTTACGATGAA | 63 | F | 421 |
| 1342610 | N/A | N/A | 4985 | 5000 | ACTTAACTTGCACCTT | 46 | F | 422 |
| 1342642 | N/A | N/A | 4266 | 4281 | CTAAATCCGAGAGAGG | 55 | F | 423 |
| 1342643 | 633 | 648 | 14327 | 14342 | CATGTTGAGGAAATCA | 43 | F | 424 |
| 1342677 | 1911 | 1926 | 15605 | 15620 | AAATAGCTATATCCTA | 77 | F | 425 |
| 1342689 | 1610 | 1625 | 15304 | 15319 | AATACATATAACACGC | 17 | F | 426 |
| 1342728 | N/A | N/A | 7556 | 7571 | TCATATACCATGTTAG | 48 | F | 427 |
| 1342732 | 351 | 366 | 14045 | 14060 | TACAGATCAGCAAGAG | 48 | F | 428 |
| 1342736 | N/A | N/A | 5926 | 5941 | ATAACTAAGGGCATCT | 69 | F | 429 |
| 1342741 | N/A | N/A | 5511 | 5526 | ATATTTGTGTACACGA | 32 | F | 430 |
| 1342746 | N/A | N/A | 8047 | 8062 | CCTAAACAACCATGGA | 98 | F | 431 |
| 1342751 | 2171 | 2186 | 15865 | 15880 | TATAGGTGTAAACTAT | 106 | F | 432 |
| 1342757 | N/A | N/A | 7806 | 7821 | CCACAGAGTATCTTAT | 74 | F | 433 |
| 1342766 | N/A | N/A | 8739 | 8754 | GTTTAAAGCATAGTTA | 97 | F | 434 |
| 1342768 | 1151 | 1166 | 14845 | 14860 | TGACTAATCTCACTGT | 64 | F | 435 |
| 1342769 | N/A | N/A | 4159 | 4174 | TAGTTAAGAATATTCG | 72 | F | 436 |
| 1342782 | N/A | N/A | 11115 | 11130 | GTAAAGACATACACCC | 85 | F | 437 |
| 1342848 | N/A | N/A | 11684 | 11699 | CAACATATTACTACCT | 64 | F | 438 |
| 1342854 | N/A | N/A | 12042 | 12057 | ATTATTATCTCACTAC | 69 | F | 439 |
| 1342866 | N/A | N/A | 12357 | 12372 | TGGGTAAAAGTTCTAA | 67 | F | 440 |
| 1342890 | N/A | N/A | 7342 | 7357 | GCATTAATCTCCATCT | 37 | F | 441 |
| 1342896 | N/A | N/A | 11956 | 11971 | CCACAAGCTATTGCTG | 34 | F | 442 |
| 1342932 | N/A | N/A | 8326 | 8341 | ATCCTATTTTTGGAGT | 90 | F | 443 |
| 1342969 | N/A | N/A | 3615 | 3630 | CAGTAACCAGGATCAA | 46 | F | 444 |
| 1342974 | 241 | 256 | 13935 | 13950 | GAGCGAGTGAGGTATT | 50 | F | 445 |
| 1342986 | N/A | N/A | 9377 | 9392 | GGACGAATGTTTGAGC | 90 | F | 446 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342994 | 1537 | 1552 | 15231 | 15246 | CTATTAGGTAGTTAAG | 45 | F | 447 |
| 1343019 | 716 | 731 | 14410 | 14425 | ATATGAAGTGAACTTG | 78 | F | 448 |
| 1343031 | 182 | 197 | 13876 | 13891 | TAAGTGGTCGAGAGAA | 9† | F | 449 |
| 1343049 | 528 | 543 | 14222 | 14237 | GGTAACAATAAGTTTT | 24 | F | 450 |
| 1343051 | 1980 | 1995 | 15674 | 15689 | GATCTATAATTTAGCT | 76 | F | 451 |
| 1343072 | N/A | N/A | 8542 | 8557 | CTAAACTTAAATCTGC | 165 | F | 452 |
| 1343084 | N/A | N/A | 6291 | 6306 | AAAGATGGAGTACCTT | 55 | F | 453 |
| 1343112 | 1269 | 1284 | 14963 | 14978 | GTCTTAAGGTTTCATG | 15 | F | 454 |
| 1343129 | N/A | N/A | 9550 | 9565 | TTATTTAGTATCCTAG | 69 | F | 455 |
| 1343133 | N/A | N/A | 13816 | 13831 | AGGTAGCCTGGAATGT | 79† | F | 456 |
| 1343142 | 917 | 932 | 14611 | 14626 | GATTCTGATAGTTACT | 17 | F | 457 |
| 1343160 | N/A | N/A | 12246 | 12261 | GCATACAACAAATTGT | 57 | F | 458 |
| 1343165 | N/A | N/A | 4943 | 4958 | CAATGTATGGTACTAC | 45 | F | 459 |
| 1343168 | N/A | N/A | 6579 | 6594 | TGACAATTTAGCTTAT | 85 | F | 460 |
| 1343174 | N/A | N/A | 12817 | 12832 | ACAATTCAAATACGGT | 37 | F | 461 |
| 1343180 | N/A | N/A | 6156 | 6171 | GTACAAAGAGACTACT | 79 | F | 462 |
| 1343185 | 425 | 440 | 14119 | 14134 | GACAGATTTTAAGCTG | 33 | F | 463 |
| 1343191 | 994 | 1009 | 14688 | 14703 | TTCCATACTTGATTCT | 28 | F | 464 |
| 1343199 | N/A | N/A | 10718 | 10733 | ACAACAAGCTCCCCAT | 81 | F | 465 |
| 1343203 | N/A | N/A | 3802 | 3817 | TGTAAATAGCTCAGTT | 32 | F | 466 |
| 1343213 | 2256 | 2271 | 15950 | 15965 | GTTAATTACACATCCT | 42 | F | 467 |
| 1343225 | 2870 | 2885 | 16564 | 16579 | GAACTTATTCTATAGT | 95 | F | 468 |
| 998326 | 240 | 255 | 13934 | 13949 | AGCGAGTGAGGTATTG | 32 | G | 469 |
| 1121455 | 1506 | 1521 | 15200 | 15215 | GAATTGTCAGCTCCCC | 11 | G | 198 |
| 1342191 | N/A | N/A | 11680 | 11695 | ATATTACTACCTTACC | 82 | G | 470 |
| 1342195 | N/A | N/A | 8288 | 8303 | ATAATTTATGGCATGG | 69 | G | 471 |
| 1342207 | N/A | N/A | 7555 | 7570 | CATATACCATGTTAGG | 50 | G | 472 |
| 1342233 | N/A | N/A | 8498 | 8513 | ATTTAATTTATTGGGC | 50 | G | 473 |
| 1342270 | 993 | 1008 | 14687 | 14702 | TCCATACTTGATTCTC | 13 | G | 474 |
| 1342292 | 1234 | 1249 | 14928 | 14943 | GTAAGCTAGGTAACTC | 41 | G | 475 |
| 1342325 | 715 | 730 | 14409 | 14424 | TATGAAGTGAACTTGT | 22 | G | 476 |
| 1342337 | 1491 | 1506 | 15185 | 15200 | CTAACCCCCATGTTCA | 61 | G | 477 |
| 1342351 | N/A | N/A | 10062 | 10077 | CCTATTTGAACATATG | 82 | G | 478 |
| 1342365 | N/A | N/A | 4984 | 4999 | CTTAACTTGCACCTTA | 51 | G | 479 |
| 1342372 | N/A | N/A | 4543 | 4558 | TCTTATTTGTAGTGAG | 45 | G | 480 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342385 | N/A | N/A | 3614 | 3629 | AGTAACCAGGATCAAA | 51 | G | 481 |
| 1342395 | N/A | N/A | 8733 | 8748 | AGCATAGTTAACATAC | 56 | G | 482 |
| 1342402 | N/A | N/A | 12813 | 12828 | TTCAAATACGGTGGGA | 70 | G | 483 |
| 1342414 | N/A | N/A | 7341 | 7356 | CATTAATCTCCATCTA | 68 | G | 484 |
| 1342415 | 2170 | 2185 | 15864 | 15879 | ATAGGTGTAAACTATT | 99 | G | 485 |
| 1342419 | N/A | N/A | 13486 | 13501 | AAGTATTGGAGTAATC | 79 | G | 486 |
| 1342424 | N/A | N/A | 4693 | 4708 | CATAAGACACCTACAC | 81 | G | 487 |
| 1342428 | N/A | N/A | 11511 | 11526 | GACTAGTTAGAACCCG | 15 | G | 488 |
| 1342429 | 1910 | 1925 | 15604 | 15619 | AATAGCTATATCCTAT | 94 | G | 489 |
| 1342435 | N/A | N/A | 12243 | 12258 | TACAACAAATTGTTCC | 87 | G | 490 |
| 1342450 | 2068 | 2083 | 15762 | 15777 | TTATGAGTTATTGGAA | 64 | G | 491 |
| 1342455 | 1195 | 1210 | 14889 | 14904 | GCCTTAAATGAAGATT | 40 | G | 492 |
| 1342464 | N/A | N/A | 9549 | 9564 | TATTTAGTATCCTAGT | 73 | G | 493 |
| 1342486 | N/A | N/A | 12041 | 12056 | TTATTATCTCACTACC | 53 | G | 494 |
| 1342496 | 181 | 196 | 13875 | 13890 | AAGTGGTCGAGAGAAA | 25† | G | 495 |
| 1342504 | N/A | N/A | 3831 | 3846 | AGTCAAATGACTATTC | 67 | G | 496 |
| 1342553 | N/A | N/A | 6826 | 6841 | TAAACTTGGACATTCT | 46 | G | 497 |
| 1342562 | N/A | N/A | 7799 | 7814 | GTATCTTATGTCTGTG | 46 | G | 498 |
| 1342565 | N/A | N/A | 7106 | 7121 | GATATACTCTAGGATG | 65 | G | 499 |
| 1342571 | N/A | N/A | 5925 | 5940 | TAACTAAGGGCATCTG | 78 | G | 500 |
| 1342578 | N/A | N/A | 6275 | 6290 | TTCAAAGGCACTAGAG | 90 | G | 501 |
| 1342599 | 1567 | 1582 | 15261 | 15276 | TTATCAGTAAGGTTTA | 30 | G | 502 |
| 1342645 | N/A | N/A | 6066 | 6081 | TTTAGGTATCAGATGA | 29 | G | 503 |
| 1342665 | 1819 | 1834 | 15513 | 15528 | CCACACCCCTAAGACA | 108 | G | 504 |
| 1342673 | 916 | 931 | 14610 | 14625 | ATTCTGATAGTTACTA | 34 | G | 505 |
| 1342674 | N/A | N/A | 6155 | 6170 | TACAAAGAGACTACTT | 77 | G | 506 |
| 1342680 | N/A | N/A | 6411 | 6426 | AGGTAGTATTGAGAAA | 18 | G | 507 |
| 1342683 | 347 | 362 | 14041 | 14056 | GATCAGCAAGAGACAT | 76 | G | 508 |
| 1342687 | N/A | N/A | 6900 | 6915 | GATTTACGATGAATCT | 96 | G | 509 |
| 1342723 | N/A | N/A | 5674 | 5689 | ATATAGAGGATGTGCA | 68 | G | 510 |
| 1342726 | N/A | N/A | 12356 | 12371 | GGGTAAAAGTTCTAAC | 66 | G | 511 |
| 1342733 | N/A | N/A | 9707 | 9722 | AGTTATTAAGGTGGAA | 56 | G | 512 |
| 1342781 | N/A | N/A | 11112 | 11127 | AAGACATACACCCATG | 88 | G | 513 |
| 1342792 | 630 | 645 | 14324 | 14339 | GTTGAGGAAATCAACA | 112 | G | 514 |
| 1342829 | N/A | N/A | 4942 | 4957 | AATGTATGGTACTACC | 40 | G | 515 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342831 | N/A | N/A | 10645 | 10660 | GTTAAAAATAAGGGAC | 86 | G | 516 |
| 1342838 | N/A | N/A | 11409 | 11424 | TAGTAGACTGGGCATT | 55 | G | 517 |
| 1342839 | N/A | N/A | 6578 | 6593 | GACAATTTAGCTTATT | 79 | G | 518 |
| 1342873 | 1314 | 1329 | 15008 | 15023 | GGATGTTAGGCTGGAA | 7 | G | 519 |
| 1342881 | 94 | 109 | 3356 | 3371 | AGTATAGAGTATTGTG | 48 | G | 520 |
| 1342892 | N/A | N/A | 6965 | 6980 | CATAAGTGAATGTGCA | 40 | G | 521 |
| 1342893 | 825 | 840 | 14519 | 14534 | TTATTACTTTGATACT | 57 | G | 522 |
| 1342930 | 423 | 438 | 14117 | 14132 | CAGATTTTAAGCTGAT | 93 | G | 523 |
| 1342939 | N/A | N/A | 4253 | 4268 | AGGAAATGGAGTACCA | 90 | G | 524 |
| 1342940 | N/A | N/A | 4807 | 4822 | TTAGAGTAATATGTGA | 48 | G | 525 |
| 1342959 | 1534 | 1549 | 15228 | 15243 | TTAGGTAGTTAAGATT | 12 | G | 526 |
| 1342981 | 387 | 402 | 14081 | 14096 | AGGTTGTAGCAGAACT | 55 | G | 527 |
| 1342982 | N/A | N/A | 13814 | 13829 | GTAGCCTGGAATGTAA | 75† | G | 528 |
| 1342983 | N/A | N/A | 8961 | 8976 | GATTAACTAGTTCTAA | 61 | G | 529 |
| 1342998 | N/A | N/A | 5399 | 5414 | AACTAGACTTTAGGTT | 98 | G | 530 |
| 1343001 | N/A | N/A | 12546 | 12561 | CTTAAACATGCCAGTG | 99 | G | 531 |
| 1343022 | 1068 | 1083 | 14762 | 14777 | TGTACTAGAATTCTGT | 27 | G | 532 |
| 1343027 | 1268 | 1283 | 14962 | 14977 | TCTTAAGGTTTCATGA | 57 | G | 533 |
| 1343039 | N/A | N/A | 11931 | 11946 | CCTATACTTTGATGAT | 57 | G | 534 |
| 1343073 | 518 | 533 | 14212 | 14227 | AGTTTTAGTCTTAATC | 36 | G | 535 |
| 1343074 | 1977 | 1992 | 15671 | 15686 | CTATAATTTAGCTCAG | 35 | G | 536 |
| 1343085 | 1098 | 1113 | 14792 | 14807 | GTCTTAGAACAGATTT | 31 | G | 537 |
| 1343091 | N/A | N/A | 5502 | 5517 | TACACGAGTATATTAG | 23 | G | 538 |
| 1343094 | N/A | N/A | 7460 | 7475 | ATGTAATATCAGATGC | 47 | G | 539 |
| 1343116 | N/A | N/A | 3801 | 3816 | GTAAATAGCTCAGTTC | 33 | G | 540 |
| 1343128 | 1150 | 1165 | 14844 | 14859 | GACTAATCTCACTGTC | 91 | G | 541 |
| 1343146 | N/A | N/A | 7968 | 7983 | ACACAAGAGTGGTATT | 64 | G | 542 |
| 1343221 | 2856 | 2871 | 16550 | 16565 | GTAGAACATATTTGAG | 60 | G | 543 |
| 1343222 | 2255 | 2270 | 15949 | 15964 | TTAATTACACATCCTC | 54 | G | 544 |
| 1343223 | N/A | N/A | 4116 | 4131 | AAATTATTCTCTAACG | 84 | G | 545 |
| 1121455 | 1506 | 1521 | 15200 | 15215 | GAATTGTCAGCTCCCC | 17 | H | 198 |
| 1342174 | N/A | N/A | 6825 | 6840 | AAACTTGGACATTCTA | 61 | H | 546 |
| 1342194 | N/A | N/A | 8287 | 8302 | TAATTTATGGCATGGT | 86 | H | 547 |
| 1342201 | N/A | N/A | 11679 | 11694 | TATTACTACCTTACCC | 79 | H | 548 |
| 1342213 | N/A | N/A | 5673 | 5688 | TATAGAGGATGTGCAT | 48 | H | 549 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342218 | N/A | N/A | 4672 | 4687 | GACTTTTATGTACTAT | 33 | H | 550 |
| 1342221 | N/A | N/A | 4974 | 4989 | ACCTTAAGGTATAGAT | 70 | H | 551 |
| 1342243 | 92 | 107 | 3354 | 3369 | TATAGAGTATTGTGTT | 63 | H | 552 |
| 1342272 | N/A | N/A | 7797 | 7812 | ATCTTATGTCTGTGGA | 73 | H | 553 |
| 1342274 | N/A | N/A | 9706 | 9721 | GTTATTAAGGTGGAAT | 83 | H | 554 |
| 1342286 | 1971 | 1986 | 15665 | 15680 | TTTAGCTCAGTAGAGT | 47 | H | 555 |
| 1342294 | 1066 | 1081 | 14760 | 14775 | TACTAGAATTCTGTGA | 45 | H | 556 |
| 1342296 | 421 | 436 | 14115 | 14130 | GATTTTAAGCTGATGT | 31 | H | 557 |
| 1342310 | 1818 | 1833 | 15512 | 15527 | CACACCCCTAAGACAA | 71 | H | 558 |
| 1342314 | N/A | N/A | 7320 | 7335 | TAAGTATGTTCACTTC | 90 | H | 559 |
| 1342316 | N/A | N/A | 3799 | 3814 | AAATAGCTCAGTTCTG | 60 | H | 560 |
| 1342320 | N/A | N/A | 6409 | 6424 | GTAGTATTGAGAAAGT | 28 | H | 561 |
| 1342324 | N/A | N/A | 3612 | 3627 | TAACCAGGATCAAAGA | 160 | H | 562 |
| 1342330 | N/A | N/A | 7102 | 7117 | TACTCTAGGATGTTTT | 64 | H | 563 |
| 1342341 | 625 | 640 | 14319 | 14334 | GGAAATCAACAGTTGC | 10 | H | 564 |
| 1342368 | 1490 | 1505 | 15184 | 15199 | TAACCCCCATGTTCAA | 59 | H | 565 |
| 1342375 | N/A | N/A | 4252 | 4267 | GGAAATGGAGTACCAC | 87 | H | 566 |
| 1342388 | 176 | 191 | 13870 | 13885 | GTCGAGAGAAAGATAA | 43† | H | 567 |
| 1342416 | N/A | N/A | 8732 | 8747 | GCATAGTTAACATACT | 43 | H | 568 |
| 1342421 | N/A | N/A | 7967 | 7982 | CACAAGAGTGGTATTC | 62 | H | 569 |
| 1342441 | N/A | N/A | 10638 | 10653 | ATAAGGGACATAGCAG | 88 | H | 570 |
| 1342466 | 1233 | 1248 | 14927 | 14942 | TAAGCTAGGTAACTCT | 57 | H | 571 |
| 1342472 | 714 | 729 | 14408 | 14423 | ATGAAGTGAACTTGTT | 57 | H | 572 |
| 1342478 | 1186 | 1201 | 14880 | 14895 | GAAGATTAGATTCTGT | 33 | H | 573 |
| 1342487 | N/A | N/A | 6577 | 6592 | ACAATTTAGCTTATTG | 94 | H | 574 |
| 1342511 | N/A | N/A | 7554 | 7569 | ATATACCATGTTAGGC | 45 | H | 575 |
| 1342528 | N/A | N/A | 12812 | 12827 | TCAAATACGGTGGGAT | 26 | H | 576 |
| 1342532 | 232 | 247 | 13926 | 13941 | AGGTATTGGACTTTCT | 241 | H | 577 |
| 1342533 | N/A | N/A | 12040 | 12055 | TATTATCTCACTACCA | 73 | H | 578 |
| 1342547 | 2067 | 2082 | 15761 | 15776 | TATGAGTTATTGGAAG | 58 | H | 579 |
| 1342548 | 1564 | 1579 | 15258 | 15273 | TCAGTAAGGTTTATGG | 23 | H | 580 |
| 1342560 | 1148 | 1163 | 14842 | 14857 | CTAATCTCACTGTCAC | 24 | H | 581 |
| 1342600 | 346 | 361 | 14040 | 14055 | ATCAGCAAGAGACATA | 49 | H | 582 |
| 1342604 | N/A | N/A | 4884 | 4899 | CTGTTAACTGAGACAT | 63 | H | 583 |
| 1342605 | N/A | N/A | 10054 | 10069 | AACATATGGTTTTGTG | 84 | H | 584 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342606 | N/A | N/A | 6942 | 6957 | TTTTTTGGACTTGTGG | 16 | H | 585 |
| 1342663 | N/A | N/A | 4806 | 4821 | TAGAGTAATATGTGAT | 44 | H | 586 |
| 1342672 | 1313 | 1328 | 15007 | 15022 | GATGTTAGGCTGGAAT | 32 | H | 587 |
| 1342725 | N/A | N/A | 5394 | 5409 | GACTTTAGGTTTTTTA | 49 | H | 588 |
| 1342738 | N/A | N/A | 7459 | 7474 | TGTAATATCAGATGCA | 20 | H | 589 |
| 1342754 | 991 | 1006 | 14685 | 14700 | CATACTTGATTCTCAT | 33 | H | 590 |
| 1342783 | 384 | 399 | 14078 | 14093 | TTGTAGCAGAACTTCA | 76 | H | 591 |
| 1342788 | N/A | N/A | 11368 | 11383 | CATAATATTGGTCTGT | 38 | H | 592 |
| 1342796 | N/A | N/A | 11111 | 11126 | AGACATACACCCATGA | 86 | H | 593 |
| 1342810 | 2169 | 2184 | 15863 | 15878 | TAGGTGTAAACTATTT | 59 | H | 594 |
| 1342820 | 1909 | 1924 | 15603 | 15618 | ATAGCTATATCCTATT | 77 | H | 595 |
| 1342845 | N/A | N/A | 8494 | 8509 | AATTTATTGGGCTCAA | 47 | H | 596 |
| 1342861 | 1093 | 1108 | 14787 | 14802 | AGAACAGATTTATGAT | 38 | H | 597 |
| 1342872 | N/A | N/A | 4542 | 4557 | CTTATTTGTAGTGAGC | 15 | H | 598 |
| 1342922 | N/A | N/A | 6059 | 6074 | ATCAGATGAATTGAAG | 40 | H | 599 |
| 1342929 | N/A | N/A | 11510 | 11525 | ACTAGTTAGAACCCGG | 83 | H | 600 |
| 1342941 | N/A | N/A | 13485 | 13500 | AGTATTGGAGTAATCC | 65 | H | 601 |
| 1343007 | N/A | N/A | 6899 | 6914 | ATTTACGATGAATCTG | 74 | H | 602 |
| 1343015 | N/A | N/A | 3830 | 3845 | GTCAAATGACTATTCA | 86 | H | 603 |
| 1343018 | N/A | N/A | 6154 | 6169 | ACAAAGAGACTACTTG | 76 | H | 604 |
| 1343024 | N/A | N/A | 8955 | 8970 | CTAGTTCTAATAACAA | 82 | H | 605 |
| 1343053 | N/A | N/A | 11900 | 11915 | TTACATGTCATTACAG | 49 | H | 606 |
| 1343054 | 515 | 530 | 14209 | 14224 | TTTAGTCTTAATCTTG | 26 | H | 607 |
| 1343061 | N/A | N/A | 12530 | 12545 | AACCTAATGTGCACTG | 50 | H | 608 |
| 1343077 | N/A | N/A | 5501 | 5516 | ACACGAGTATATTAGG | 9 | H | 609 |
| 1343108 | N/A | N/A | 12242 | 12257 | ACAACAAATTGTTCCC | 12 | H | 610 |
| 1343124 | 913 | 928 | 14607 | 14622 | CTGATAGTTACTACAA | 22 | H | 611 |
| 1343141 | 822 | 837 | 14516 | 14531 | TTACTTTGATACTTGG | 7 | H | 612 |
| 1343156 | 1533 | 1548 | 15227 | 15242 | TAGGTAGTTAAGATTT | 37 | H | 613 |
| 1343167 | N/A | N/A | 6274 | 6289 | TCAAAGGCACTAGAGG | 70 | H | 614 |
| 1343173 | 1265 | 1280 | 14959 | 14974 | TAAGGTTTCATGATTC | 14 | H | 615 |
| 1343179 | N/A | N/A | 5924 | 5939 | AACTAAGGGCATCTGT | 80 | H | 616 |
| 1343187 | N/A | N/A | 9541 | 9556 | ATCCTAGTACTTAGTG | 101 | H | 617 |
| 1343201 | N/A | N/A | 13786 | 13801 | GATTAGAATCATCTAT | 101 | H | 618 |
| 1343205 | N/A | N/A | 12355 | 12370 | GGTAAAAGTTCTAACA | 75 | H | 619 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343209 | N/A | N/A | 3981 | 3996 | TGTTAAAAGTTGACTG | 94 | H | 620 |
| 1343217 | 2220 | 2235 | 15914 | 15929 | ATATTAGTAACATGTC | 103 | H | 621 |
| 1343220 | 2733 | 2748 | 16427 | 16442 | AGTTATAGTATTCTGT | 58 | H | 622 |
| 1121455 | 1506 | 1521 | 15200 | 15215 | GAATTGTCAGCTCCCC | 21 | I | 198 |
| 1342170 | N/A | N/A | 13460 | 13475 | TCCATAAGTTCCTGGA | 76 | I | 623 |
| 1342172 | N/A | N/A | 7083 | 7098 | CATCTAATTGGTTTAG | 76 | I | 624 |
| 1342197 | N/A | N/A | 8944 | 8959 | AACAATTTGTTAGTTG | 90 | I | 625 |
| 1342198 | N/A | N/A | 6268 | 6283 | GCACTAGAGGTCCTCA | 68 | I | 626 |
| 1342211 | N/A | N/A | 8286 | 8301 | AATTTATGGCATGGTT | 81 | I | 627 |
| 1342224 | 712 | 727 | 14406 | 14421 | GAAGTGAACTTGTTGG | 34 | I | 628 |
| 1342230 | 1967 | 1982 | 15661 | 15676 | GCTCAGTAGAGTGGAC | 67 | I | 629 |
| 1342261 | 1312 | 1327 | 15006 | 15021 | ATGTTAGGCTGGAATG | 47 | I | 630 |
| 1342277 | N/A | N/A | 9540 | 9555 | TCCTAGTACTTAGTGC | 75 | I | 631 |
| 1342284 | 1264 | 1279 | 14958 | 14973 | AAGGTTTCATGATTCC | 15 | I | 632 |
| 1342304 | 1908 | 1923 | 15602 | 15617 | TAGCTATATCCTATTA | 57 | I | 633 |
| 1342306 | 419 | 434 | 14113 | 14128 | TTTTAAGCTGATGTGG | 33 | I | 634 |
| 1342321 | 1488 | 1503 | 15182 | 15197 | ACCCCCATGTTCAAGG | 69 | I | 635 |
| 1342326 | 91 | 106 | 3353 | 3368 | ATAGAGTATTGTGTTG | 36 | I | 636 |
| 1342363 | N/A | N/A | 5359 | 5374 | ACATAATTTAGTGTAC | 107 | I | 637 |
| 1342369 | 1563 | 1578 | 15257 | 15272 | CAGTAAGGTTTATGGT | 32 | I | 638 |
| 1342373 | N/A | N/A | 5859 | 5874 | GACTATTAAGAATGTA | 91 | I | 639 |
| 1342378 | 149 | 164 | 13843 | 13858 | CCAAATATGAGATAAC | 77† | I | 640 |
| 1342405 | N/A | N/A | 7965 | 7980 | CAAGAGTGGTATTCAT | 43 | I | 641 |
| 1342412 | N/A | N/A | 7284 | 7299 | CAGTATTTTTGGTGGT | 11 | I | 642 |
| 1342437 | N/A | N/A | 4805 | 4820 | AGAGTAATATGTGATA | 44 | I | 643 |
| 1342475 | 624 | 639 | 14318 | 14333 | GAAATCAACAGTTGCA | 14 | I | 644 |
| 1342476 | N/A | N/A | 6806 | 6821 | GAAGTTACTTTGTGGT | 25 | I | 645 |
| 1342517 | 2063 | 2078 | 15757 | 15772 | AGTTATTGGAAGATGT | 47 | I | 646 |
| 1342536 | 990 | 1005 | 14684 | 14699 | ATACTTGATTCTCATC | 18 | I | 647 |
| 1342555 | N/A | N/A | 8708 | 8723 | GATCTTATAATCCTAC | 62 | I | 648 |
| 1342559 | N/A | N/A | 4530 | 4545 | GAGCAATAGAATTAAC | 62 | I | 649 |
| 1342563 | N/A | N/A | 11104 | 11119 | CACCCATGAATATTCA | 94 | I | 650 |
| 1342582 | N/A | N/A | 11859 | 11874 | AACTGTATTAACTGTC | 70 | I | 651 |
| 1342594 | 2167 | 2182 | 15861 | 15876 | GGTGTAAACTATTTTA | 65 | I | 652 |
| 1342611 | 1147 | 1162 | 14841 | 14856 | TAATCTCACTGTCACA | 34 | I | 653 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342613 | N/A | N/A | 9703 | 9718 | ATTAAGGTGGAATTGG | 54 | I | 654 |
| 1342622 | 912 | 927 | 14606 | 14621 | TGATAGTTACTACAAA | 69 | I | 655 |
| 1342627 | N/A | N/A | 6930 | 6945 | GTGGTAATAAATTAGG | 38 | I | 656 |
| 1342635 | 1085 | 1100 | 14779 | 14794 | TTTATGATTTACCTAC | 52 | I | 657 |
| 1342646 | N/A | N/A | 12032 | 12047 | CACTACCACAGACATA | N.D. | I | 658 |
| 1342653 | N/A | N/A | 12348 | 12363 | GTTCTAACATATAGTT | 69 | I | 659 |
| 1342660 | N/A | N/A | 4883 | 4898 | TGTTAACTGAGACATA | 73 | I | 660 |
| 1342669 | N/A | N/A | 6055 | 6070 | GATGAATTGAAGGCAT | 56 | I | 661 |
| 1342690 | N/A | N/A | 3724 | 3739 | ATTAACCACTACTACC | 118 | I | 662 |
| 1342701 | 345 | 360 | 14039 | 14054 | TCAGCAAGAGACATAT | 58 | I | 663 |
| 1342707 | 1184 | 1199 | 14878 | 14893 | AGATTAGATTCTGTTG | 29 | I | 664 |
| 1342731 | N/A | N/A | 4234 | 4249 | GAGGATAATAACTTGA | 29 | I | 665 |
| 1342776 | N/A | N/A | 13777 | 13792 | CATCTATGTAACCTAT | 95 | I | 666 |
| 1342777 | 513 | 528 | 14207 | 14222 | TAGTCTTAATCTTGAC | N.D. | I | 667 |
| 1342780 | N/A | N/A | 12241 | 12256 | CAACAAATTGTTCCCT | 80 | I | 668 |
| 1342801 | N/A | N/A | 11356 | 11371 | CTGTAGCAAGGAGTTC | 57 | I | 669 |
| 1342821 | N/A | N/A | 6576 | 6591 | CAATTTAGCTTATTGC | 93 | I | 670 |
| 1342868 | N/A | N/A | 6896 | 6911 | TACGATGAATCTGTTG | 88 | I | 671 |
| 1342874 | N/A | N/A | 12760 | 12775 | GCATTTGTATGATCAC | 29 | I | 672 |
| 1342888 | N/A | N/A | 6407 | 6422 | AGTATTGAGAAAGTCT | 32 | I | 673 |
| 1342924 | N/A | N/A | 7553 | 7568 | TATACCATGTTAGGCA | 58 | I | 674 |
| 1342944 | N/A | N/A | 5500 | 5515 | CACGAGTATATTAGGA | 10 | I | 675 |
| 1342951 | N/A | N/A | 11509 | 11524 | CTAGTTAGAACCCGGC | 56 | I | 676 |
| 1342954 | N/A | N/A | 10623 | 10638 | GCTTAAACTTGACATA | 78 | I | 677 |
| 1342968 | N/A | N/A | 4972 | 4987 | CTTAAGGTATAGATGA | 58 | I | 678 |
| 1342971 | N/A | N/A | 12529 | 12544 | ACCTAATGTGCACTGT | 79 | I | 679 |
| 1342996 | 821 | 836 | 14515 | 14530 | TACTTTGATACTTGGT | 19 | I | 680 |
| 1342999 | N/A | N/A | 10019 | 10034 | GTCTTAAAAGGTCAGA | 76 | I | 681 |
| 1343026 | 1065 | 1080 | 14759 | 14774 | ACTAGAATTCTGTGAT | 33 | I | 682 |
| 1343106 | N/A | N/A | 7779 | 7794 | CATGATTACTCTACTT | 50 | I | 683 |
| 1343107 | N/A | N/A | 3598 | 3613 | GATGAATATGACCTTT | 23 | I | 684 |
| 1343118 | N/A | N/A | 3823 | 3838 | GACTATTCATATTAGT | 73 | I | 685 |
| 1343119 | 1232 | 1247 | 14926 | 14941 | AAGCTAGGTAACTCTA | 60 | I | 686 |
| 1343122 | N/A | N/A | 5599 | 5614 | GATCTTGAGCAGTTCA | 78 | I | 687 |
| 1343126 | N/A | N/A | 3980 | 3995 | GTTAAAAGTTGACTGG | 30 | I | 688 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343134 | 1531 | 1546 | 15225 | 15240 | GGTAGTTAAGATTTTG | 13 | I | 689 |
| 1343149 | N/A | N/A | 11670 | 11685 | CTTACCCCAGGTGTCA | 92 | I | 690 |
| 1343153 | N/A | N/A | 4665 | 4680 | ATGTACTATCAAAGGA | 65 | I | 691 |
| 1343161 | N/A | N/A | 7457 | 7472 | TAATATCAGATGCATT | 43 | I | 692 |
| 1343170 | N/A | N/A | 8493 | 8508 | ATTTATTGGGCTCAAT | 76 | I | 693 |
| 1343176 | N/A | N/A | 6147 | 6162 | GACTACTTGATTCTAG | 82 | I | 694 |
| 1343192 | 224 | 239 | 13918 | 13933 | GACTTTCTCCATGATA | 21† | I | 695 |
| 1343204 | 1817 | 1832 | 15511 | 15526 | ACACCCCTAAGACAAG | 137 | I | 696 |
| 1343208 | 372 | 387 | 14066 | 14081 | TTCAGAGAAGCATCAC | N.D. | I | 697 |
| 1343231 | 2728 | 2743 | 16422 | 16437 | TAGTATTCTGTAATCC | 64 | I | 698 |
| 1343232 | 2219 | 2234 | 15913 | 15928 | TATTAGTAACATGTCT | 29 | I | 699 |
| 1091598 | 560 | 575 | 14254 | 14269 | ATGTTTACAAGATCCA | 8 | J | 700 |
| 1121455 | 1506 | 1521 | 15200 | 15215 | GAATTGTCAGCTCCCC | 10 | J | 198 |
| 1342161 | 1254 | 1269 | 14948 | 14963 | GATTCCAAAGATATAG | 16 | J | 701 |
| 1342165 | N/A | N/A | 4971 | 4986 | TTAAGGTATAGATGAA | 87 | J | 702 |
| 1342186 | N/A | N/A | 8703 | 8718 | TATAATCCTACAACAG | 34 | J | 703 |
| 1342205 | 1560 | 1575 | 15254 | 15269 | TAAGGTTTATGGTCAA | 6 | J | 704 |
| 1342209 | N/A | N/A | 7726 | 7741 | TACTATTCTTTGTGGG | 55 | J | 705 |
| 1342215 | N/A | N/A | 8447 | 8462 | ATCCTAGTTCTACTGA | 70 | J | 706 |
| 1342229 | N/A | N/A | 3499 | 3514 | GCCTAAGATTGAACTG | 59 | J | 707 |
| 1342232 | N/A | N/A | 4519 | 4534 | TTAACATTTGTCATAG | 43 | J | 708 |
| 1342245 | 1816 | 1831 | 15510 | 15525 | CACCCCTAAGACAAGA | 79 | J | 709 |
| 1342246 | 1906 | 1921 | 15600 | 15615 | GCTATATCCTATTACA | 58 | J | 710 |
| 1342259 | N/A | N/A | 3723 | 3738 | TTAACCACTACTACCA | 64 | J | 711 |
| 1342262 | N/A | N/A | 5565 | 5580 | AAATTGTAGAATAGGG | 79 | J | 712 |
| 1342279 | 1138 | 1153 | 14832 | 14847 | TGTCACATATTAACCA | 29 | J | 713 |
| 1342281 | 911 | 926 | 14605 | 14620 | GATAGTTACTACAAAT | 44 | J | 714 |
| 1342303 | 1948 | 1963 | 15642 | 15657 | AAAATAGATGCTTACC | 52 | J | 715 |
| 1342323 | N/A | N/A | 3978 | 3993 | TAAAAGTTGACTGGAC | 50 | J | 716 |
| 1342327 | 2189 | 2204 | 15883 | 15898 | AATTGTTGGATTATGC | 32 | J | 717 |
| 1342332 | N/A | N/A | 9940 | 9955 | GAAGCATATACAGGAG | 37 | J | 718 |
| 1342393 | 989 | 1004 | 14683 | 14698 | TACTTGATTCTCATCA | 37 | J | 719 |
| 1342396 | N/A | N/A | 12027 | 12042 | CCACAGACATATCCTA | 40 | J | 720 |
| 1342400 | N/A | N/A | 4643 | 4658 | TGAGTATAGAGATATG | 26 | J | 721 |
| 1342417 | N/A | N/A | 13776 | 13791 | ATCTATGTAACCTATC | 40 | J | 722 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342444 | N/A | N/A | 9538 | 9553 | CTAGTACTTAGTGCAT | 69 | J | 723 |
| 1342448 | 1228 | 1243 | 14922 | 14937 | TAGGTAACTCTAGCTC | 48 | J | 724 |
| 1342471 | N/A | N/A | 7929 | 7944 | CAAATTGTCTTCTAGG | 79 | J | 725 |
| 1342482 | N/A | N/A | 13438 | 13453 | GACTTTACGCAAAACA | 72 | J | 726 |
| 1342515 | N/A | N/A | 11068 | 11083 | GCAAAGACATGAACCG | 50 | J | 727 |
| 1342546 | 820 | 835 | 14514 | 14529 | ACTTTGATACTTGGTG | 24 | J | 728 |
| 1342564 | N/A | N/A | 5341 | 5356 | GTGTAATGAGTACATT | 74 | J | 729 |
| 1342570 | N/A | N/A | 6575 | 6590 | AATTTAGCTTATTGCT | 130 | J | 730 |
| 1342581 | N/A | N/A | 12315 | 12330 | CTGTAGATGTAATTGG | 17 | J | 731 |
| 1342586 | N/A | N/A | 5850 | 5865 | GAATGTAATGCTATGC | 11 | J | 732 |
| 1342591 | 2164 | 2179 | 15858 | 15873 | GTAAACTATTTTAGAC | 96 | J | 733 |
| 1342624 | N/A | N/A | 8943 | 8958 | ACAATTTGTTAGTTGG | 51 | J | 734 |
| 1342626 | N/A | N/A | 11636 | 11651 | GTCCTTTTATACATCC | 38 | J | 735 |
| 1342658 | 1302 | 1317 | 14996 | 15011 | GGAATGGAAGACAACC | 28 | J | 736 |
| 1342668 | N/A | N/A | 5499 | 5514 | ACGAGTATATTAGGAA | 5 | J | 737 |
| 1342679 | N/A | N/A | 7548 | 7563 | CATGTTAGGCAACATG | 102 | J | 738 |
| 1342696 | N/A | N/A | 8285 | 8300 | ATTTATGGCATGGTTG | 104 | J | 739 |
| 1342698 | N/A | N/A | 4233 | 4248 | AGGATAATAACTTGAC | 9 | J | 740 |
| 1342755 | 1082 | 1097 | 14776 | 14791 | ATGATTTACCTACATG | 79 | J | 741 |
| 1342756 | N/A | N/A | 7280 | 7295 | ATTTTTGGTGGTATTC | 32 | J | 742 |
| 1342761 | N/A | N/A | 11858 | 11873 | ACTGTATTAACTGTCC | 36 | J | 743 |
| 1342763 | N/A | N/A | 7082 | 7097 | ATCTAATTGGTTTAGA | 74 | J | 744 |
| 1342775 | N/A | N/A | 10532 | 10547 | CTTTAAGTTGCTTATG | 58 | J | 745 |
| 1342824 | 371 | 386 | 14065 | 14080 | TCAGAGAAGCATCACG | 47 | J | 746 |
| 1342836 | N/A | N/A | 4804 | 4819 | GAGTAATATGTGATAT | 88 | J | 747 |
| 1342855 | N/A | N/A | 6406 | 6421 | GTATTGAGAAAGTCTT | 31 | J | 748 |
| 1342876 | 418 | 433 | 14112 | 14127 | TTTAAGCTGATGTGGC | 21 | J | 749 |
| 1342908 | 342 | 357 | 14036 | 14051 | GCAAGAGACATATTAA | 37 | J | 750 |
| 1342909 | N/A | N/A | 6928 | 6943 | GGTAATAAATTAGGAC | 26 | J | 751 |
| 1342911 | 1530 | 1545 | 15224 | 15239 | GTAGTTAAGATTTTGC | 8 | J | 752 |
| 1342917 | N/A | N/A | 4881 | 4896 | TTAACTGAGACATACT | 75 | J | 753 |
| 1342931 | 1470 | 1485 | 15164 | 15179 | CAGCTGTAGATGTAAT | 61 | J | 754 |
| 1342935 | N/A | N/A | 11475 | 11490 | ACCATATGGTTTATGG | 81 | J | 755 |
| 1342952 | 88 | 103 | 3350 | 3365 | GAGTATTGTGTTGTAT | 14 | J | 756 |
| 1342960 | 145 | 160 | 13839 | 13854 | ATATGAGATAACTGTC | 52† | J | 757 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342965 | 1172 | 1187 | 14866 | 14881 | GTTGTTAGTATATTAG | 28 | J | 758 |
| 1342975 | N/A | N/A | 6054 | 6069 | ATGAATTGAAGGCATG | 74 | J | 759 |
| 1343008 | N/A | N/A | 6126 | 6141 | CTAGAATAAAGTATCG | 70 | J | 760 |
| 1343010 | 1020 | 1035 | 14714 | 14729 | TATTATGTAAGAGTAT | 112 | J | 761 |
| 1343020 | 711 | 726 | 14405 | 14420 | AAGTGAACTTGTTGGC | 16 | J | 762 |
| 1343034 | N/A | N/A | 12239 | 12254 | ACAAATTGTTCCCTGG | 68 | J | 763 |
| 1343041 | N/A | N/A | 6746 | 6761 | GAATCTTCAAGCTGCT | 32 | J | 764 |
| 1343045 | N/A | N/A | 6893 | 6908 | GATGAATCTGTTGGCT | 34 | J | 765 |
| 1343048 | 2059 | 2074 | 15753 | 15768 | ATTGGAAGATGTTCTG | 55 | J | 766 |
| 1343063 | 509 | 524 | 14203 | 14218 | CTTAATCTTGACCTTT | 21 | J | 767 |
| 1343064 | N/A | N/A | 3821 | 3836 | CTATTCATATTAGTTC | 57 | J | 768 |
| 1343066 | N/A | N/A | 12498 | 12513 | GAAACCAGAGTCCCAC | 66 | J | 769 |
| 1343075 | 218 | 233 | 13912 | 13927 | CTCCATGATACCAGCA | 10† | J | 770 |
| 1343083 | N/A | N/A | 9702 | 9717 | TTAAGGTGGAATTGGT | 47 | J | 771 |
| 1343097 | N/A | N/A | 7436 | 7451 | GCGGAAGGAACCTCAA | 91 | J | 772 |
| 1343102 | N/A | N/A | 12735 | 12750 | TACCAATTTTTATTCG | 79 | J | 773 |
| 1343158 | N/A | N/A | 6267 | 6282 | CACTAGAGGTCCTCAG | 68 | J | 774 |
| 1343211 | N/A | N/A | 11353 | 11368 | TAGCAAGGAGTTCCAA | 94 | J | 775 |
| 1343226 | 2633 | 2648 | 16327 | 16342 | GTAACAAACAGTGTAA | 60 | J | 776 |
| 1121455 | 1506 | 1521 | 15200 | 15215 | GAATTGTCAGCTCCCC | 22 | K | 198 |
| 1342175 | N/A | N/A | 9936 | 9951 | CATATACAGGAGTCAT | 59 | K | 777 |
| 1342177 | N/A | N/A | 6677 | 6692 | TCCTAAATTGACCCAT | 52 | K | 778 |
| 1342181 | N/A | N/A | 6053 | 6068 | TGAATTGAAGGCATGA | 45 | K | 779 |
| 1342210 | N/A | N/A | 8855 | 8870 | CCTAAATTAATGGTTA | 76 | K | 780 |
| 1342227 | N/A | N/A | 4878 | 4893 | ACTGAGACATACTAGT | 94 | K | 781 |
| 1342241 | N/A | N/A | 4968 | 4983 | AGGTATAGATGAACTA | 64 | K | 782 |
| 1342244 | 2188 | 2203 | 15882 | 15897 | ATTGTTGGATTATGCA | 37 | K | 783 |
| 1342256 | 1559 | 1574 | 15253 | 15268 | AAGGTTTATGGTCAAT | 9 | K | 784 |
| 1342258 | N/A | N/A | 12017 | 12032 | ATCCTATTTACAGACT | 81 | K | 785 |
| 1342269 | N/A | N/A | 5563 | 5578 | ATTGTAGAATAGGGAT | 35 | K | 786 |
| 1342307 | 1225 | 1240 | 14919 | 14934 | GTAACTCTAGCTCAGA | 26 | K | 787 |
| 1342339 | 368 | 383 | 14062 | 14077 | GAGAAGCATCACGATG | 35 | K | 788 |
| 1342371 | 341 | 356 | 14035 | 14050 | CAAGAGACATATTAAG | 65 | K | 789 |
| 1342427 | N/A | N/A | 7546 | 7561 | TGTTAGGCAACATGTT | 64 | K | 790 |
| 1342452 | N/A | N/A | 12734 | 12749 | ACCAATTTTTATTCGA | 65 | K | 791 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342460 | N/A | N/A | 7908 | 7923 | GAATCAAGAGTATTGA | 28 | K | 792 |
| 1342470 | 1905 | 1920 | 15599 | 15614 | CTATATCCTATTACAG | 48 | K | 793 |
| 1342483 | 818 | 833 | 14512 | 14527 | TTTGATACTTGGTGAA | 23 | K | 794 |
| 1342484 | 909 | 924 | 14603 | 14618 | TAGTTACTACAAATAG | 44 | K | 795 |
| 1342490 | N/A | N/A | 5294 | 5309 | ACTATTGTATTTATGC | 57 | K | 796 |
| 1342500 | 987 | 1002 | 14681 | 14696 | CTTGATTCTCATCAAC | 64 | K | 797 |
| 1342539 | N/A | N/A | 7073 | 7088 | GTTTAGAAGATTAGAA | 76 | K | 798 |
| 1342567 | 559 | 574 | 14253 | 14268 | TGTTTACAAGATCCAA | 24 | K | 799 |
| 1342575 | N/A | N/A | 6574 | 6589 | ATTTAGCTTATTGCTG | 91 | K | 800 |
| 1342601 | 1081 | 1096 | 14775 | 14790 | TGATTTACCTACATGT | 44 | K | 801 |
| 1342607 | 1137 | 1152 | 14831 | 14846 | GTCACATATTAACCAC | 28 | K | 802 |
| 1342609 | N/A | N/A | 7679 | 7694 | TCAAGAAAAGTAACGC | 78 | K | 803 |
| 1342616 | 216 | 231 | 13910 | 13925 | CCATGATACCAGCAGG | 39† | K | 804 |
| 1342623 | N/A | N/A | 6249 | 6264 | GACTATGAGTATGCTG | 33 | K | 805 |
| 1342625 | N/A | N/A | 11856 | 11871 | TGTATTAACTGTCCAG | 23 | K | 806 |
| 1342634 | N/A | N/A | 8284 | 8299 | TTTATGGCATGGTTGT | 58 | K | 807 |
| 1342649 | N/A | N/A | 7411 | 7426 | GAAAACTTTTGGTGGC | 22 | K | 808 |
| 1342671 | N/A | N/A | 4232 | 4247 | GGATAATAACTTGACA | 52 | K | 809 |
| 1342675 | 417 | 432 | 14111 | 14126 | TTAAGCTGATGTGGCA | 33 | K | 810 |
| 1342686 | 2047 | 2062 | 15741 | 15756 | TCTGAAATGGTCAGAG | 79 | K | 811 |
| 1342694 | 1252 | 1267 | 14946 | 14961 | TTCCAAAGATATAGTA | 41 | K | 812 |
| 1342695 | 487 | 502 | 14181 | 14196 | AGAAACTCTTCTACTC | 72 | K | 813 |
| 1342702 | N/A | N/A | 6927 | 6942 | GTAATAAATTAGGACA | 80 | K | 814 |
| 1342734 | 710 | 725 | 14404 | 14419 | AGTGAACTTGTTGGCA | 29 | K | 815 |
| 1342739 | N/A | N/A | 6405 | 6420 | TATTGAGAAAGTCTTA | 88 | K | 816 |
| 1342764 | N/A | N/A | 9669 | 9684 | TTTAATAGGGCTTTAG | 79 | K | 817 |
| 1342785 | 81 | 96 | 3343 | 3358 | GTGTTGTATGAAGTCT | 17 | K | 818 |
| 1342794 | 1529 | 1544 | 15223 | 15238 | TAGTTAAGATTTTGCG | 22 | K | 819 |
| 1342814 | N/A | N/A | 9537 | 9552 | TAGTACTTAGTGCATA | 59 | K | 820 |
| 1342853 | N/A | N/A | 13736 | 13751 | CACTAATTCATCTTCC | 89 | K | 821 |
| 1342857 | 1301 | 1316 | 14995 | 15010 | GAATGGAAGACAACCT | 53 | K | 822 |
| 1342859 | N/A | N/A | 11474 | 11489 | CCATATGGTTTATGGT | 79 | K | 823 |
| 1342878 | N/A | N/A | 7131 | 7146 | CAAGTAATATCTAAGG | 39 | K | 824 |
| 1342879 | N/A | N/A | 8655 | 8670 | TGGAAACAAATTGGGT | 49 | K | 825 |
| 1342882 | N/A | N/A | 6881 | 6896 | GGCTTACAAAAGTTCA | 19 | K | 826 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342902 | N/A | N/A | 13431 | 13446 | CGCAAAACAACATATA | 86 | K | 827 |
| 1342919 | N/A | N/A | 4518 | 4533 | TAACATTTGTCATAGG | 16 | K | 828 |
| 1342926 | N/A | N/A | 8427 | 8442 | CAACATTTGTATGATG | 86 | K | 829 |
| 1342937 | 1811 | 1826 | 15505 | 15520 | CTAAGACAAGACTGCA | 53 | K | 830 |
| 1342947 | 1019 | 1034 | 14713 | 14728 | ATTATGTAAGAGTATG | 93 | K | 831 |
| 1342956 | N/A | N/A | 3817 | 3832 | TCATATTAGTTCAGAT | 50 | K | 832 |
| 1342961 | N/A | N/A | 3977 | 3992 | AAAAGTTGACTGGACT | 56 | K | 833 |
| 1342989 | N/A | N/A | 11635 | 11650 | TCCTTTTATACATCCC | 13 | K | 834 |
| 1342992 | N/A | N/A | 4802 | 4817 | GTAATATGTGATATAG | 70 | K | 835 |
| 1343012 | 1469 | 1484 | 15163 | 15178 | AGCTGTAGATGTAATA | 70 | K | 836 |
| 1343038 | 1170 | 1185 | 14864 | 14879 | TGTTAGTATATTAGTG | 73 | K | 837 |
| 1343043 | N/A | N/A | 3498 | 3513 | CCTAAGATTGAACTGA | 51 | K | 838 |
| 1343044 | 2139 | 2154 | 15833 | 15848 | AACTTTAGTCAACTTA | 44 | K | 839 |
| 1343047 | N/A | N/A | 6124 | 6139 | AGAATAAAGTATCGAA | 95 | K | 840 |
| 1343069 | 144 | 159 | 13838 | 13853 | TATGAGATAACTGTCT | 47† | K | 841 |
| 1343080 | N/A | N/A | 11259 | 11274 | TCTAAACAGGTGGCTA | 79 | K | 842 |
| 1343086 | N/A | N/A | 12312 | 12327 | TAGATGTAATTGGTTT | 37 | K | 843 |
| 1343115 | N/A | N/A | 3716 | 3731 | CTACTACCAAATATGG | 94 | K | 844 |
| 1343120 | N/A | N/A | 5827 | 5842 | GAATTTAAATGGAGTG | 60 | K | 845 |
| 1343123 | N/A | N/A | 5489 | 5504 | TAGGAAATTGCTCTTT | 47 | K | 846 |
| 1343125 | N/A | N/A | 12238 | 12253 | CAAATTGTTCCCTGGA | 82 | K | 847 |
| 1343169 | N/A | N/A | 4642 | 4657 | GAGTATAGAGATATGG | 18 | K | 848 |
| 1343177 | 1946 | 1961 | 15640 | 15655 | AATAGATGCTTACCAT | 73 | K | 849 |
| 1343194 | N/A | N/A | 12472 | 12487 | AGAATATGCAAGCCCC | 73 | K | 850 |
| 1343210 | N/A | N/A | 10491 | 10506 | GCTTATTGTAGATCTA | 23 | K | 851 |
| 1343230 | N/A | N/A | 11066 | 11081 | AAAGACATGAACCGGC | 47 | K | 852 |
| 1343233 | 2612 | 2627 | 16306 | 16321 | GGAATATGACTAATCA | 48 | K | 853 |
| 1121455 | 1506 | 1521 | 15200 | 15215 | GAATTGTCAGCTCCCC | 13 | L | 198 |
| 1342164 | N/A | N/A | 5163 | 5178 | TAGGAAATGATAGTGC | 33 | L | 854 |
| 1342178 | 2183 | 2198 | 15877 | 15892 | TGGATTATGCAGTATA | 16 | L | 855 |
| 1342185 | N/A | N/A | 7893 | 7908 | AAAACATGAAAGGTGC | 48 | L | 856 |
| 1342203 | N/A | N/A | 7522 | 7537 | GCTACTATATATCAAC | 50 | L | 857 |
| 1342220 | N/A | N/A | 12471 | 12486 | GAATATGCAAGCCCCA | 62 | L | 858 |
| 1342235 | N/A | N/A | 4641 | 4656 | AGTATAGAGATATGGA | 19 | L | 859 |
| 1342248 | N/A | N/A | 11467 | 11482 | GTTTATGGTGTTTAGA | 46 | L | 860 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342278 | 143 | 158 | 13837 | 13852 | ATGAGATAACTGTCTT | 68† | L | 861 |
| 1342290 | N/A | N/A | 5428 | 5443 | TGGTAATATATTGTCT | 49 | L | 862 |
| 1342308 | N/A | N/A | 10770 | 10785 | GCAGAAAACTGTTGGG | 262 | L | 863 |
| 1342342 | 79 | 94 | 3341 | 3356 | GTTGTATGAAGTCTTA | 13 | L | 864 |
| 1342347 | N/A | N/A | 12015 | 12030 | CCTATTTACAGACTTC | 39 | L | 865 |
| 1342349 | 2046 | 2061 | 15740 | 15755 | CTGAAATGGTCAGAGG | 43 | L | 866 |
| 1342350 | N/A | N/A | 7050 | 7065 | TAGATTGAATAAACAG | 84 | L | 867 |
| 1342359 | N/A | N/A | 11633 | 11648 | CTTTTATACATCCCAT | 52 | L | 868 |
| 1342361 | 1300 | 1315 | 14994 | 15009 | AATGGAAGACAACCTG | 36 | L | 869 |
| 1342370 | N/A | N/A | 9536 | 9551 | AGTACTTAGTGCATAA | 96 | L | 870 |
| 1342406 | N/A | N/A | 6676 | 6691 | CCTAAATTGACCCATA | 48 | L | 871 |
| 1342422 | N/A | N/A | 8850 | 8865 | ATTAATGGTTACCTGA | 44 | L | 872 |
| 1342430 | N/A | N/A | 6119 | 6134 | AAAGTATCGAAATGTG | 86 | L | 873 |
| 1342443 | N/A | N/A | 3976 | 3991 | AAAGTTGACTGGACTT | 142 | L | 874 |
| 1342453 | 486 | 501 | 14180 | 14195 | GAAACTCTTCTACTCA | 42 | L | 875 |
| 1342473 | N/A | N/A | 4966 | 4981 | GTATAGATGAACTAGT | 68 | L | 876 |
| 1342495 | N/A | N/A | 8418 | 8433 | TATGATGATAATTAGG | 40 | L | 877 |
| 1342497 | N/A | N/A | 5562 | 5577 | TTGTAGAATAGGGATG | 54 | L | 878 |
| 1342501 | N/A | N/A | 8653 | 8668 | GAAACAAATTGGGTGT | 50 | L | 879 |
| 1342506 | N/A | N/A | 8197 | 8212 | TTCTTAACAGCTAAGC | 56 | L | 880 |
| 1342510 | N/A | N/A | 12733 | 12748 | CCAATTTTTATTCGAT | 81 | L | 881 |
| 1342513 | N/A | N/A | 7638 | 7653 | CAAGATGGTATTCTGG | 32 | L | 882 |
| 1342516 | N/A | N/A | 6569 | 6584 | GCTTATTGCTGTTGCT | 78 | L | 883 |
| 1342519 | N/A | N/A | 9668 | 9683 | TTAATAGGGCTTTAGT | 77 | L | 884 |
| 1342524 | N/A | N/A | 6403 | 6418 | TTGAGAAAGTCTTAAG | 54 | L | 885 |
| 1342529 | 1131 | 1146 | 14825 | 14840 | TATTAACCACCAGTTC | 44 | L | 886 |
| 1342568 | 1165 | 1180 | 14859 | 14874 | GTATATTAGTGATATG | 94 | L | 887 |
| 1342579 | 555 | 570 | 14249 | 14264 | TACAAGATCCAACAGA | 55 | L | 888 |
| 1342588 | N/A | N/A | 4874 | 4889 | AGACATACTAGTGAGC | 45 | L | 889 |
| 1342590 | N/A | N/A | 6243 | 6258 | GAGTATGCTGTACATC | 27 | L | 890 |
| 1342608 | N/A | N/A | 9934 | 9949 | TATACAGGAGTCATCC | 71 | L | 891 |
| 1342636 | 965 | 980 | 14659 | 14674 | AGATGTTAATGTGGCA | 5 | L | 892 |
| 1342650 | N/A | N/A | 6039 | 6054 | GAGTATTTTAGCAATG | 44 | L | 893 |
| 1342654 | 1810 | 1825 | 15504 | 15519 | TAAGACAAGACTGCAA | 75 | L | 894 |
| 1342659 | 817 | 832 | 14511 | 14526 | TTGATACTTGGTGAAG | 23 | L | 895 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342678 | N/A | N/A | 6923 | 6938 | TAAATTAGGACAGTTC | 66 | L | 896 |
| 1342684 | N/A | N/A | 3816 | 3831 | CATATTAGTTCAGATG | 74 | L | 897 |
| 1342709 | N/A | N/A | 5774 | 5789 | GAATTTGCCTTTTGCC | 21 | L | 898 |
| 1342711 | 338 | 353 | 14032 | 14047 | GAGACATATTAAGATG | 63 | L | 899 |
| 1342713 | 416 | 431 | 14110 | 14125 | TAAGCTGATGTGGCAA | 29 | L | 900 |
| 1342717 | 1224 | 1239 | 14918 | 14933 | TAACTCTAGCTCAGAT | 59 | L | 901 |
| 1342790 | N/A | N/A | 3715 | 3730 | TACTACCAAATATGGT | 95 | L | 902 |
| 1342815 | N/A | N/A | 4221 | 4236 | TGACAAAACTATAGGC | 38 | L | 903 |
| 1342830 | N/A | N/A | 11258 | 11273 | CTAAACAGGTGGCTAA | 81 | L | 904 |
| 1342846 | N/A | N/A | 12310 | 12325 | GATGTAATTGGTTTGA | 23 | L | 905 |
| 1342871 | N/A | N/A | 7130 | 7145 | AAGTAATATCTAAGGC | 63 | L | 906 |
| 1342885 | 1904 | 1919 | 15598 | 15613 | TATATCCTATTACAGT | 77 | L | 907 |
| 1342903 | 214 | 229 | 13908 | 13923 | ATGATACCAGCAGGAC | 47† | L | 908 |
| 1342918 | N/A | N/A | 6880 | 6895 | GCTTACAAAAGTTCAC | 48 | L | 909 |
| 1342920 | 1557 | 1572 | 15251 | 15266 | GGTTTATGGTCAATAG | 12 | L | 910 |
| 1342927 | 908 | 923 | 14602 | 14617 | AGTTACTACAAATAGT | 60 | L | 911 |
| 1342948 | 1080 | 1095 | 14774 | 14789 | GATTTACCTACATGTA | 36 | L | 912 |
| 1342949 | 1524 | 1539 | 15218 | 15233 | AAGATTTTGCGGACCC | 18 | L | 913 |
| 1342955 | N/A | N/A | 13717 | 13732 | GCACTATTGTTATTTA | 53 | L | 914 |
| 1342997 | 707 | 722 | 14401 | 14416 | GAACTTGTTGGCAGTG | 40 | L | 915 |
| 1343009 | 367 | 382 | 14061 | 14076 | AGAAGCATCACGATGA | 48 | L | 916 |
| 1343023 | N/A | N/A | 3497 | 3512 | CTAAGATTGAACTGAT | 63 | L | 917 |
| 1343033 | 1945 | 1960 | 15639 | 15654 | ATAGATGCTTACCATT | 45 | L | 918 |
| 1343042 | N/A | N/A | 11855 | 11870 | GTATTAACTGTCCAGA | 26 | L | 919 |
| 1343055 | 1015 | 1030 | 14709 | 14724 | TGTAAGAGTATGGCCT | 41 | L | 920 |
| 1343056 | 1250 | 1265 | 14944 | 14959 | CCAAAGATATAGTATG | 25 | L | 921 |
| 1343057 | N/A | N/A | 7393 | 7408 | GCTTTATGACTTGCTA | 47 | L | 922 |
| 1343065 | 2133 | 2148 | 15827 | 15842 | AGTCAACTTAAATTAC | 109 | L | 923 |
| 1343081 | 1466 | 1481 | 15160 | 15175 | TGTAGATGTAATAGAT | 14 | L | 924 |
| 1343096 | N/A | N/A | 4774 | 4789 | ACAATAAAATAACTCG | 85 | L | 925 |
| 1343132 | N/A | N/A | 13409 | 13424 | CCATTTTTACCCTAGG | 51 | L | 926 |
| 1343151 | N/A | N/A | 4511 | 4526 | TGTCATAGGAATTGAG | 23 | L | 927 |
| 1343193 | N/A | N/A | 12195 | 12210 | TGTTAAATGGGAAGTG | 58 | L | 928 |
| 1343202 | N/A | N/A | 10486 | 10501 | TTGTAGATCTAGTGGA | 65 | L | 929 |
| 1343214 | 2611 | 2626 | 16305 | 16320 | GAATATGACTAATCAG | 69 | L | 930 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121455 | 1506 | 1521 | 15200 | 15215 | GAATTGTCAGCTCCCC | 19 | M | 198 |
| 1342179 | 814 | 829 | 14508 | 14523 | ATACTTGGTGAAGACC | 22 | M | 931 |
| 1342180 | N/A | N/A | 11632 | 11647 | TTTTATACATCCCATA | 73 | M | 932 |
| 1342184 | N/A | N/A | 6922 | 6937 | AAATTAGGACAGTTCA | 58 | M | 933 |
| 1342188 | 1555 | 1570 | 15249 | 15264 | TTTATGGTCAATAGTA | 39 | M | 934 |
| 1342208 | 1942 | 1957 | 15636 | 15651 | GATGCTTACCATTTGG | 53 | M | 935 |
| 1342237 | N/A | N/A | 6879 | 6894 | CTTACAAAAGTTCACT | 75 | M | 936 |
| 1342268 | N/A | N/A | 12470 | 12485 | AATATGCAAGCCCCAC | 77 | M | 937 |
| 1342280 | N/A | N/A | 4214 | 4229 | ACTATAGGCATTAATA | 74 | M | 938 |
| 1342282 | 1807 | 1822 | 15501 | 15516 | GACAAGACTGCAAGAC | 44 | M | 939 |
| 1342288 | 554 | 569 | 14248 | 14263 | ACAAGATCCAACAGAT | 59 | M | 940 |
| 1342297 | 480 | 495 | 14174 | 14189 | CTTCTACTCAGGAAGT | 110 | M | 941 |
| 1342309 | 1249 | 1264 | 14943 | 14958 | CAAAGATATAGTATGG | 16 | M | 942 |
| 1342317 | N/A | N/A | 8826 | 8841 | GTATTAACCTGAACTA | 103 | M | 943 |
| 1342340 | 1299 | 1314 | 14993 | 15008 | ATGGAAGACAACCTGC | 46 | M | 944 |
| 1342343 | 78 | 93 | 3340 | 3355 | TTGTATGAAGTCTTAC | 55 | M | 945 |
| 1342344 | N/A | N/A | 13530 | 13545 | GAGTAGTAACTTTAGT | 68 | M | 946 |
| 1342360 | N/A | N/A | 3704 | 3719 | ATGGTAACATAATTGG | 18 | M | 947 |
| 1342374 | 964 | 979 | 14658 | 14673 | GATGTTAATGTGGCAT | 38 | M | 948 |
| 1342376 | N/A | N/A | 11458 | 11473 | GTTTAGATTCTGTAGT | 40 | M | 949 |
| 1342379 | N/A | N/A | 4510 | 4525 | GTCATAGGAATTGAGA | 13 | M | 950 |
| 1342383 | N/A | N/A | 6009 | 6024 | AAACTTTGATTGATTG | 75 | M | 951 |
| 1342384 | N/A | N/A | 6209 | 6224 | GTTTATTTGGTAACAC | 80 | M | 952 |
| 1342390 | N/A | N/A | 8641 | 8656 | GTGTAAAGGAGATGAC | 65 | M | 953 |
| 1342391 | 907 | 922 | 14601 | 14616 | GTTACTACAAATAGTT | 74 | M | 954 |
| 1342401 | 366 | 381 | 14060 | 14075 | GAAGCATCACGATGAT | 35 | M | 955 |
| 1342431 | N/A | N/A | 9788 | 9803 | CCTTTTGATTGTCTGC | 38 | M | 956 |
| 1342433 | 706 | 721 | 14400 | 14415 | AACTTGTTGGCAGTGC | 40 | M | 957 |
| 1342434 | N/A | N/A | 9528 | 9543 | GTGCATAATTGGTATG | 61 | M | 958 |
| 1342520 | N/A | N/A | 6667 | 6682 | ACCCATAATGAAGTGC | 50 | M | 959 |
| 1342522 | 336 | 351 | 14030 | 14045 | GACATATTAAGATGAG | 35 | M | 960 |
| 1342525 | N/A | N/A | 4965 | 4980 | TATAGATGAACTAGTT | 68 | M | 961 |
| 1342530 | N/A | N/A | 10481 | 10496 | GATCTAGTGGATTGGA | 62 | M | 962 |
| 1342542 | N/A | N/A | 12194 | 12209 | GTTAAATGGGAAGTGT | 55 | M | 963 |
| 1342550 | N/A | N/A | 12308 | 12323 | TGTAATTGGTTTGATC | 25 | M | 964 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342592 | N/A | N/A | 7047 | 7062 | ATTGAATAAACAGGAC | 49 | M | 965 |
| 1342632 | 142 | 157 | 13836 | 13851 | TGAGATAACTGTCTTC | 28† | M | 966 |
| 1342637 | N/A | N/A | 7595 | 7610 | TAGAAAAGCCATTAGG | 103 | M | 967 |
| 1342641 | N/A | N/A | 10747 | 10762 | CTTAATAACGGGATGA | 78 | M | 968 |
| 1342644 | N/A | N/A | 3871 | 3886 | GATAATATTGGAATAG | 42 | M | 969 |
| 1342651 | N/A | N/A | 6369 | 6384 | CTTAATAAATATACCC | 118 | M | 970 |
| 1342652 | N/A | N/A | 4753 | 4768 | ACCCAATTTGAAGTGT | 79 | M | 971 |
| 1342685 | 1465 | 1480 | 15159 | 15174 | GTAGATGTAATAGATG | 30 | M | 972 |
| 1342704 | N/A | N/A | 8413 | 8428 | TGATAATTAGGCCAGA | 26 | M | 973 |
| 1342708 | N/A | N/A | 7521 | 7536 | CTACTATATATCAACT | 94 | M | 974 |
| 1342718 | N/A | N/A | 4640 | 4655 | GTATAGAGATATGGAG | 18 | M | 975 |
| 1342729 | N/A | N/A | 6118 | 6133 | AAGTATCGAAATGTGA | 87 | M | 976 |
| 1342760 | N/A | N/A | 9660 | 9675 | GCTTTAGTGTTATCTA | 54 | M | 977 |
| 1342779 | N/A | N/A | 11237 | 11252 | GTTATTTAGGTTGTCT | 27 | M | 978 |
| 1342807 | N/A | N/A | 5560 | 5575 | GTAGAATAGGGATGCA | 50 | M | 979 |
| 1342809 | 1993 | 2008 | 15687 | 15702 | AATAGCATAGCTGGAT | 54 | M | 980 |
| 1342812 | 1523 | 1538 | 15217 | 15232 | AGATTTTGCGGACCCA | 15 | M | 981 |
| 1342816 | 1902 | 1917 | 15596 | 15611 | TATCCTATTACAGTTG | 45 | M | 982 |
| 1342818 | N/A | N/A | 8196 | 8211 | TCTTAACAGCTAAGCT | 58 | M | 983 |
| 1342823 | N/A | N/A | 6557 | 6572 | TGCTATATTGTCTGTA | 49 | M | 984 |
| 1342825 | 213 | 228 | 13907 | 13922 | TGATACCAGCAGGACA | 66† | M | 985 |
| 1342833 | N/A | N/A | 4872 | 4887 | ACATACTAGTGAGCTA | 69 | M | 986 |
| 1342837 | N/A | N/A | 3815 | 3830 | ATATTAGTTCAGATGT | 57 | M | 987 |
| 1342841 | N/A | N/A | 5698 | 5713 | TTACTTTAAGCCATGC | 53 | M | 988 |
| 1342850 | 2181 | 2196 | 15875 | 15890 | GATTATGCAGTATAGG | 43 | M | 989 |
| 1342852 | 1129 | 1144 | 14823 | 14838 | TTAACCACCAGTTCTC | 26 | M | 990 |
| 1342860 | N/A | N/A | 11854 | 11869 | TATTAACTGTCCAGAG | 55 | M | 991 |
| 1342906 | N/A | N/A | 5427 | 5442 | GGTAATATATTGTCTA | 28 | M | 992 |
| 1342910 | 1012 | 1027 | 14706 | 14721 | AAGAGTATGGCCTTAC | 45 | M | 993 |
| 1342925 | N/A | N/A | 12000 | 12015 | CTACTTAATAGTAGTA | 106 | M | 994 |
| 1342950 | N/A | N/A | 3496 | 3511 | TAAGATTGAACTGATA | 68 | M | 995 |
| 1342967 | 1223 | 1238 | 14917 | 14932 | AACTCTAGCTCAGATA | 69 | M | 996 |
| 1342980 | 1164 | 1179 | 14858 | 14873 | TATATTAGTGATATGA | 89 | M | 997 |
| 1343004 | N/A | N/A | 12732 | 12747 | CAATTTTTATTCGATA | 91 | M | 998 |
| 1343032 | N/A | N/A | 7126 | 7141 | AATATCTAAGGCTACA | 62 | M | 999 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343059 | 1079 | 1094 | 14773 | 14788 | ATTTACCTACATGTAC | 65 | M | 1000 |
| 1343095 | N/A | N/A | 7889 | 7904 | CATGAAAGGTGCTTGT | 30 | M | 1001 |
| 1343098 | 405 | 420 | 14099 | 14114 | GGCAAGCTGCAGATCT | 22 | M | 1002 |
| 1343139 | 2132 | 2147 | 15826 | 15841 | GTCAACTTAAATTACC | 42 | M | 1003 |
| 1343144 | N/A | N/A | 7392 | 7407 | CTTTATGACTTGCTAG | 61 | M | 1004 |
| 1343148 | N/A | N/A | 13327 | 13342 | TCTCAATAAAGACCCC | 99 | M | 1005 |
| 1343154 | N/A | N/A | 5159 | 5174 | AAATGATAGTGCTGTC | 13 | M | 1006 |
| 1343215 | 2606 | 2621 | 16300 | 16315 | TGACTAATCAGTTCAA | 111 | M | 1007 |
| 1091574 | 334 | 349 | 14028 | 14043 | CATATTAAGATGAGAC | 40 | N | 1008 |
| 1121455 | 1506 | 1521 | 15200 | 15215 | GAATTGTCAGCTCCCC | 10 | N | 198 |
| 1342162 | 1941 | 1956 | 15635 | 15650 | ATGCTTACCATTTGGT | 54 | N | 1009 |
| 1342163 | N/A | N/A | 11631 | 11646 | TTTATACATCCCATAA | 122 | N | 1010 |
| 1342171 | 1298 | 1313 | 14992 | 15007 | TGGAAGACAACCTGCA | 42 | N | 1011 |
| 1342225 | N/A | N/A | 9756 | 9771 | GATTCTTAAGGTTCAG | 30 | N | 1012 |
| 1342228 | 2180 | 2195 | 15874 | 15889 | ATTATGCAGTATAGGT | 28 | N | 1013 |
| 1342238 | N/A | N/A | 7378 | 7393 | AGACAATTGATACTTT | 47 | N | 1014 |
| 1342250 | 1554 | 1569 | 15248 | 15263 | TTATGGTCAATAGTAG | 18 | N | 1015 |
| 1342287 | 1128 | 1143 | 14822 | 14837 | TAACCACCAGTTCTCA | 34 | N | 1016 |
| 1342295 | 1159 | 1174 | 14853 | 14868 | TAGTGATATGACTAAT | 74 | N | 1017 |
| 1342298 | N/A | N/A | 9651 | 9666 | TTATCTATATGAGGAT | 91 | N | 1018 |
| 1342299 | N/A | N/A | 12288 | 12303 | ACTGTATTAATAGCTC | 47 | N | 1019 |
| 1342302 | 403 | 418 | 14097 | 14112 | CAAGCTGCAGATCTAG | 34 | N | 1020 |
| 1342315 | 476 | 491 | 14170 | 14185 | TACTCAGGAAGTGGTC | 46 | N | 1021 |
| 1342329 | N/A | N/A | 3412 | 3427 | AAGAATTACCAAAGTC | 71 | N | 1022 |
| 1342338 | 141 | 156 | 13835 | 13850 | GAGATAACTGTCTTCT | 72† | N | 1023 |
| 1342346 | N/A | N/A | 6666 | 6681 | CCCATAATGAAGTGCT | 32 | N | 1024 |
| 1342353 | N/A | N/A | 4964 | 4979 | ATAGATGAACTAGTTG | 39 | N | 1025 |
| 1342381 | N/A | N/A | 4638 | 4653 | ATAGAGATATGGAGAC | 16 | N | 1026 |
| 1342382 | 2122 | 2137 | 15816 | 15831 | ATTACCAAAGTTTGGT | 74 | N | 1027 |
| 1342386 | 1802 | 1817 | 15496 | 15511 | GACTGCAAGACCAACG | 47 | N | 1028 |
| 1342387 | N/A | N/A | 7125 | 7140 | ATATCTAAGGCTACAG | 64 | N | 1029 |
| 1342418 | N/A | N/A | 4752 | 4767 | CCCAATTTGAAGTGTG | 46 | N | 1030 |
| 1342420 | N/A | N/A | 12087 | 12102 | GATGTTAAGTACTGAA | 14 | N | 1031 |
| 1342426 | N/A | N/A | 8639 | 8654 | GTAAAGGAGATGACCA | 65 | N | 1032 |
| 1342440 | 553 | 568 | 14247 | 14262 | CAAGATCCAACAGATG | 53 | N | 1033 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342461 | N/A | N/A | 6556 | 6571 | GCTATATTGTCTGTAG | 74 | N | 1034 |
| 1342465 | 1078 | 1093 | 14772 | 14787 | TTTACCTACATGTACT | 50 | N | 1035 |
| 1342467 | N/A | N/A | 4869 | 4884 | TACTAGTGAGCTAAGG | 33 | N | 1036 |
| 1342527 | N/A | N/A | 13528 | 13543 | GTAGTAACTTTAGTCC | 46 | N | 1037 |
| 1342534 | N/A | N/A | 12392 | 12407 | TGGTTTAAGGTACAGC | 27 | N | 1038 |
| 1342540 | N/A | N/A | 8195 | 8210 | CTTAACAGCTAAGCTG | 85 | N | 1039 |
| 1342543 | 1222 | 1237 | 14916 | 14931 | ACTCTAGCTCAGATAA | 63 | N | 1040 |
| 1342544 | 77 | 92 | 3339 | 3354 | TGTATGAAGTCTTACG | 68 | N | 1041 |
| 1342572 | N/A | N/A | 3869 | 3884 | TAATATTGGAATAGGC | 29 | N | 1042 |
| 1342574 | N/A | N/A | 8824 | 8839 | ATTAACCTGAACTAGG | 86 | N | 1043 |
| 1342589 | N/A | N/A | 11457 | 11472 | TTTAGATTCTGTAGTG | 33 | N | 1044 |
| 1342618 | 813 | 828 | 14507 | 14522 | TACTTGGTGAAGACCT | 47 | N | 1045 |
| 1342630 | 1245 | 1260 | 14939 | 14954 | GATATAGTATGGTAAG | 17 | N | 1046 |
| 1342692 | N/A | N/A | 6921 | 6936 | AATTAGGACAGTTCAT | 87 | N | 1047 |
| 1342740 | N/A | N/A | 5697 | 5712 | TACTTTAAGCCATGCT | 54 | N | 1048 |
| 1342743 | N/A | N/A | 13243 | 13258 | ACCAGATAGGCCAGGT | 88 | N | 1049 |
| 1342750 | N/A | N/A | 4375 | 4390 | ACTAAATTGAGGATTG | 64 | N | 1050 |
| 1342759 | N/A | N/A | 5416 | 5431 | GTCTAATTTGGAGAGG | 23 | N | 1051 |
| 1342772 | 962 | 977 | 14656 | 14671 | TGTTAATGTGGCATAG | 26 | N | 1052 |
| 1342784 | N/A | N/A | 8412 | 8427 | GATAATTAGGCCAGAT | 29 | N | 1053 |
| 1342791 | N/A | N/A | 7888 | 7903 | ATGAAAGGTGCTTGTT | 40 | N | 1054 |
| 1342800 | 704 | 719 | 14398 | 14413 | CTTGTTGGCAGTGCAG | 26 | N | 1055 |
| 1342847 | N/A | N/A | 11999 | 12014 | TACTTAATAGTAGTAG | 113 | N | 1056 |
| 1342858 | N/A | N/A | 7589 | 7604 | AGCCATTAGGCAACTC | 47 | N | 1057 |
| 1342869 | N/A | N/A | 5158 | 5173 | AATGATAGTGCTGTCA | 36 | N | 1058 |
| 1342889 | N/A | N/A | 3703 | 3718 | TGGTAACATAATTGGA | 30 | N | 1059 |
| 1342907 | 211 | 226 | 13905 | 13920 | ATACCAGCAGGACAGG | 29† | N | 1060 |
| 1342914 | 1880 | 1895 | 15574 | 15589 | GAACAACAAGGGCTTG | 95 | N | 1061 |
| 1342915 | N/A | N/A | 7042 | 7057 | ATAAACAGGACTTGTC | 61 | N | 1062 |
| 1342916 | N/A | N/A | 10724 | 10739 | ATACATACAACAAGCT | 77 | N | 1063 |
| 1342942 | 1991 | 2006 | 15685 | 15700 | TAGCATAGCTGGATCT | 53 | N | 1064 |
| 1342977 | N/A | N/A | 6877 | 6892 | TACAAAAGTTCACTCC | 88 | N | 1065 |
| 1343006 | N/A | N/A | 11832 | 11847 | GTTATTAACACTTGGG | 36 | N | 1066 |
| 1343013 | N/A | N/A | 9526 | 9541 | GCATAATTGGTATGCT | 90 | N | 1067 |
| 1343036 | N/A | N/A | 10480 | 10495 | ATCTAGTGGATTGGAA | 79 | N | 1068 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343046 | 1011 | 1026 | 14705 | 14720 | AGAGTATGGCCTTACT | 33 | N | 1069 |
| 1343052 | N/A | N/A | 6202 | 6217 | TGGTAACACATGCTTC | 42 | N | 1070 |
| 1343070 | 362 | 377 | 14056 | 14071 | CATCACGATGATACAG | 57 | N | 1071 |
| 1343100 | 879 | 894 | 14573 | 14588 | ATAACAGATGTGAGGA | 16 | N | 1072 |
| 1343104 | N/A | N/A | 11225 | 11240 | GTCTATAACACTTCTA | 34 | N | 1073 |
| 1343105 | N/A | N/A | 4212 | 4227 | TATAGGCATTAATAGG | 24 | N | 1074 |
| 1343110 | N/A | N/A | 3814 | 3829 | TATTAGTTCAGATGTA | 65 | N | 1075 |
| 1343121 | N/A | N/A | 6114 | 6129 | ATCGAAATGTGATTTT | 76 | N | 1076 |
| 1343127 | 1464 | 1479 | 15158 | 15173 | TAGATGTAATAGATGG | 6 | N | 1077 |
| 1343130 | N/A | N/A | 6008 | 6023 | AACTTTGATTGATTGG | 20 | N | 1078 |
| 1343138 | N/A | N/A | 12727 | 12742 | TTTATTCGATAATAAT | 100 | N | 1079 |
| 1343150 | N/A | N/A | 7519 | 7534 | ACTATATATCAACTCC | 63 | N | 1080 |
| 1343155 | N/A | N/A | 5559 | 5574 | TAGAATAGGGATGCAG | 41 | N | 1081 |
| 1343166 | N/A | N/A | 6368 | 6383 | TTAATAAATATACCCC | 91 | N | 1082 |
| 1343171 | 1516 | 1531 | 15210 | 15225 | GCGGACCCACGAATTG | 28 | N | 1083 |
| 1343224 | 2579 | 2594 | 16273 | 16288 | GTTTTTAAGACTAGGG | 33 | N | 1084 |
| 1121455 | 1506 | 1521 | 15200 | 15215 | GAATTGTCAGCTCCCC | 17 | O | 198 |
| 1342183 | N/A | N/A | 4960 | 4975 | ATGAACTAGTTGGGAC | 46 | O | 1085 |
| 1342200 | N/A | N/A | 7124 | 7139 | TATCTAAGGCTACAGT | 64 | O | 1086 |
| 1342242 | N/A | N/A | 7029 | 7044 | GTCTATATTTGGATTG | 58 | O | 1087 |
| 1342249 | N/A | N/A | 4751 | 4766 | CCAATTTGAAGTGTGA | 34 | O | 1088 |
| 1342251 | N/A | N/A | 11743 | 11758 | TCAGTAATTAACTGCC | 78 | O | 1089 |
| 1342253 | 399 | 414 | 14093 | 14108 | CTGCAGATCTAGAGGT | 78 | O | 1090 |
| 1342300 | N/A | N/A | 6366 | 6381 | AATAAATATACCCCCT | 84 | O | 1091 |
| 1342336 | 1515 | 1530 | 15209 | 15224 | CGGACCCACGAATTGT | 56 | O | 1092 |
| 1342362 | N/A | N/A | 8823 | 8838 | TTAACCTGAACTAGGC | 88 | O | 1093 |
| 1342367 | N/A | N/A | 4374 | 4389 | CTAAATTGAGGATTGT | 45 | O | 1094 |
| 1342404 | 2179 | 2194 | 15873 | 15888 | TTATGCAGTATAGGTG | 34 | O | 1095 |
| 1342408 | N/A | N/A | 9752 | 9767 | CTTAAGGTTCAGTTTA | 56 | O | 1096 |
| 1342411 | N/A | N/A | 6920 | 6935 | ATTAGGACAGTTCATC | 4 | O | 1097 |
| 1342425 | 1077 | 1092 | 14771 | 14786 | TTACCTACATGTACTA | 48 | O | 1098 |
| 1342436 | N/A | N/A | 3622 | 3637 | GACAAACCAGTAACCA | 17 | O | 1099 |
| 1342438 | N/A | N/A | 3809 | 3824 | GTTCAGATGTAAATAG | 38 | O | 1100 |
| 1342449 | N/A | N/A | 10723 | 10738 | TACATACAACAAGCTC | 80 | O | 1101 |
| 1342451 | N/A | N/A | 9525 | 9540 | CATAATTGGTATGCTT | 40 | O | 1102 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342458 | N/A | N/A | 6188 | 6203 | TCAGAATTACTCTGGG | 78 | O | 1103 |
| 1342469 | N/A | N/A | 13822 | 13837 | TCTTTTAGGTAGCCTG | 541 | O | 1104 |
| 1342479 | N/A | N/A | 6665 | 6680 | CCATAATGAAGTGCTT | 31 | O | 1105 |
| 1342488 | 1463 | 1478 | 15157 | 15172 | AGATGTAATAGATGGG | 9 | O | 1106 |
| 1342498 | N/A | N/A | 8194 | 8209 | TTAACAGCTAAGCTGT | 99 | O | 1107 |
| 1342512 | N/A | N/A | 8638 | 8653 | TAAAGGAGATGACCAA | 77 | O | 1108 |
| 1342557 | 309 | 324 | 14003 | 14018 | TAAATAGATTCTGTAG | 80 | O | 1109 |
| 1342577 | 1723 | 1738 | 15417 | 15432 | GACTTTTATGTTGACC | 57 | O | 1110 |
| 1342597 | N/A | N/A | 12287 | 12302 | CTGTATTAATAGCTCC | 24 | O | 1111 |
| 1342602 | 652 | 667 | 14346 | 14361 | GGGATAGAAATTTGTG | 33 | O | 1112 |
| 1342633 | N/A | N/A | 12946 | 12961 | ACAAAGATAATTACCC | 78 | O | 1113 |
| 1342667 | 1219 | 1234 | 14913 | 14928 | CTAGCTCAGATAATTC | 57 | O | 1114 |
| 1342710 | N/A | N/A | 11622 | 11637 | CCCATAAAAGCCCATC | 88 | O | 1115 |
| 1342719 | N/A | N/A | 11997 | 12012 | CTTAATAGTAGTAGTT | 70 | O | 1116 |
| 1342727 | N/A | N/A | 4211 | 4226 | ATAGGCATTAATAGGC | 27 | O | 1117 |
| 1342735 | N/A | N/A | 11224 | 11239 | TCTATAACACTTCTAC | 64 | O | 1118 |
| 1342737 | 961 | 976 | 14655 | 14670 | GTTAATGTGGCATAGA | 13 | O | 1119 |
| 1342744 | N/A | N/A | 10445 | 10460 | TTATATTTGAGTAGTC | 59 | O | 1120 |
| 1342752 | N/A | N/A | 12722 | 12737 | TCGATAATAATTTGTA | 89 | O | 1121 |
| 1342758 | 1293 | 1308 | 14987 | 15002 | GACAACCTGCAAAATC | 33 | O | 1122 |
| 1342762 | 1990 | 2005 | 15684 | 15699 | AGCATAGCTGGATCTA | 72 | O | 1123 |
| 1342771 | N/A | N/A | 5134 | 5149 | AGTAAAGCAAGTACTC | 87 | O | 1124 |
| 1342773 | N/A | N/A | 12084 | 12099 | GTTAAGTACTGAAGAC | 67 | O | 1125 |
| 1342806 | 1939 | 1954 | 15633 | 15648 | GCTTACCATTTGGTTG | 57 | O | 1126 |
| 1342813 | 359 | 374 | 14053 | 14068 | CACGATGATACAGATC | 60 | O | 1127 |
| 1342817 | 788 | 803 | 14482 | 14497 | TTAGTATTAAAGAAGC | 58 | O | 1128 |
| 1342822 | N/A | N/A | 5696 | 5711 | ACTTTAAGCCATGCTG | 75 | O | 1129 |
| 1342842 | N/A | N/A | 3864 | 3879 | TTGGAATAGGCATGCT | 41 | O | 1130 |
| 1342844 | N/A | N/A | 6555 | 6570 | CTATATTGTCTGTAGG | 45 | O | 1131 |
| 1342877 | N/A | N/A | 6875 | 6890 | CAAAAGTTCACTCCAG | 60 | O | 1132 |
| 1342880 | N/A | N/A | 7588 | 7603 | GCCATTAGGCAACTCT | 83 | O | 1133 |
| 1342883 | 1158 | 1173 | 14852 | 14867 | AGTGATATGACTAATC | 53 | O | 1134 |
| 1342895 | N/A | N/A | 9648 | 9663 | TCTATATGAGGATATC | 78 | O | 1135 |
| 1342898 | 877 | 892 | 14571 | 14586 | AACAGATGTGAGGAGT | 22 | O | 1136 |
| 1342901 | N/A | N/A | 4862 | 4877 | GAGCTAAGGGTAAGTT | 45 | O | 1137 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342946 | N/A | N/A | 11417 | 11432 | GAATTATATAGTAGAC | 76 | O | 1138 |
| 1342953 | 2121 | 2136 | 15815 | 15830 | TTACCAAAGTTTGGTG | 96 | O | 1139 |
| 1342957 | 74 | 89 | 3336 | 3351 | ATGAAGTCTTACGGGT | 27 | O | 1140 |
| 1342963 | N/A | N/A | 3410 | 3425 | GAATTACCAAAGTCAG | 72 | O | 1141 |
| 1342964 | 1553 | 1568 | 15247 | 15262 | TATGGTCAATAGTAGG | 6 | O | 1142 |
| 1342978 | N/A | N/A | 7518 | 7533 | CTATATATCAACTCCT | 78 | O | 1143 |
| 1342979 | N/A | N/A | 7377 | 7392 | GACAATTGATACTTTA | 32 | O | 1144 |
| 1342988 | N/A | N/A | 5558 | 5573 | AGAATAGGGATGCAGT | 31 | O | 1145 |
| 1342993 | N/A | N/A | 8393 | 8408 | ATCCATAGAAGATGGG | 64 | O | 1146 |
| 1343002 | 1241 | 1256 | 14935 | 14950 | TAGTATGGTAAGCTAG | 86 | O | 1147 |
| 1343003 | 1124 | 1139 | 14818 | 14833 | CACCAGTTCTCATCTG | 55 | O | 1148 |
| 1343021 | N/A | N/A | 5415 | 5430 | TCTAATTTGGAGAGGT | 31 | O | 1149 |
| 1343030 | N/A | N/A | 6112 | 6127 | CGAAATGTGATTTTTG | 64 | O | 1150 |
| 1343058 | N/A | N/A | 5932 | 5947 | TGCTTAATAACTAAGG | 75 | O | 1151 |
| 1343088 | N/A | N/A | 4624 | 4639 | ACACAATTAGGATACC | 47 | O | 1152 |
| 1343117 | 475 | 490 | 14169 | 14184 | ACTCAGGAAGTGGTCT | 34 | O | 1153 |
| 1343135 | N/A | N/A | 13525 | 13540 | GTAACTTTAGTCCTTG | 36 | O | 1154 |
| 1343137 | 550 | 565 | 14244 | 14259 | GATCCAACAGATGAAT | 54 | O | 1155 |
| 1343143 | 1877 | 1892 | 15571 | 15586 | CAACAAGGGCTTGAAT | 100 | O | 1156 |
| 1343145 | 210 | 225 | 13904 | 13919 | TACCAGCAGGACAGGA | 46† | O | 1157 |
| 1343147 | N/A | N/A | 12391 | 12406 | GGTTTAAGGTACAGCT | 53 | O | 1158 |
| 1343152 | 1010 | 1025 | 14704 | 14719 | GAGTATGGCCTTACTT | 86 | O | 1159 |
| 1343200 | N/A | N/A | 7878 | 7893 | CTTGTTAGGAGTTTGG | 19 | O | 1160 |
| 1343227 | 2571 | 2586 | 16265 | 16280 | GACTAGGGATACTTTC | 70 | O | 1161 |
| 1121455 | 1506 | 1521 | 15200 | 15215 | GAATTGTCAGCTCCCC | 12 | P | 198 |
| 1342166 | N/A | N/A | 6664 | 6679 | CATAATGAAGTGCTTC | 35 | P | 1162 |
| 1342167 | 786 | 801 | 14480 | 14495 | AGTATTAAAGAAGCTT | 49 | P | 1163 |
| 1342173 | 1276 | 1291 | 14970 | 14985 | TTCTGAAGTCTTAAGG | 17 | P | 1164 |
| 1342176 | N/A | N/A | 12390 | 12405 | GTTTAAGGTACAGCTT | 92 | P | 1165 |
| 1342212 | N/A | N/A | 11994 | 12009 | AATAGTAGTAGTTTCC | 32 | P | 1166 |
| 1342223 | N/A | N/A | 12943 | 12958 | AAGATAATTACCCAGT | 38 | P | 1167 |
| 1342247 | 2178 | 2193 | 15872 | 15887 | TATGCAGTATAGGTGT | 45 | P | 1168 |
| 1342260 | N/A | N/A | 9524 | 9539 | ATAATTGGTATGCTTC | 29 | P | 1169 |
| 1342264 | N/A | N/A | 3863 | 3878 | TGGAATAGGCATGCTG | 30 | P | 1170 |
| 1342265 | 1076 | 1091 | 14770 | 14785 | TACCTACATGTACTAG | 85 | P | 1171 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342293 | N/A | N/A | 8368 | 8383 | CATACATTGAGAATTG | 62 | P | 1172 |
| 1342305 | N/A | N/A | 6908 | 6923 | CATCATTAGATTTACG | 98 | P | 1173 |
| 1342331 | 1514 | 1529 | 15208 | 15223 | GGACCCACGAATTGTC | 112 | P | 1174 |
| 1342407 | 1240 | 1255 | 14934 | 14949 | AGTATGGTAAGCTAGG | 14 | P | 1175 |
| 1342423 | N/A | N/A | 10722 | 10737 | ACATACAACAAGCTCC | 89 | P | 1176 |
| 1342454 | 1989 | 2004 | 15683 | 15698 | GCATAGCTGGATCTAT | 46 | P | 1177 |
| 1342477 | 1157 | 1172 | 14851 | 14866 | GTGATATGACTAATCT | 77 | P | 1178 |
| 1342480 | N/A | N/A | 6975 | 6990 | ACTGATAAGCCATAAG | 61 | P | 1179 |
| 1342492 | 859 | 874 | 14553 | 14568 | GTGGACTATTTTGAAT | 49 | P | 1180 |
| 1342502 | 1462 | 1477 | 15156 | 15171 | GATGTAATAGATGGGC | 26 | P | 1181 |
| 1342507 | 1938 | 1953 | 15632 | 15647 | CTTACCATTTGGTTGA | 63 | P | 1182 |
| 1342508 | N/A | N/A | 11530 | 11545 | GAAGGTAAGTATCAGG | 20 | P | 1183 |
| 1342561 | N/A | N/A | 4373 | 4388 | TAAATTGAGGATTGTA | 63 | P | 1184 |
| 1342585 | N/A | N/A | 10444 | 10459 | TATATTTGAGTAGTCA | 38 | P | 1185 |
| 1342598 | 1722 | 1737 | 15416 | 15431 | ACTTTTATGTTGACCC | 39 | P | 1186 |
| 1342614 | N/A | N/A | 7359 | 7374 | GATGTTGTATATGCTG | 10 | P | 1187 |
| 1342619 | N/A | N/A | 11415 | 11430 | ATTATATAGTAGACTG | 93 | P | 1188 |
| 1342638 | N/A | N/A | 9727 | 9742 | TCCTAGTGAAACCTTT | 75 | P | 1189 |
| 1342647 | 1009 | 1024 | 14703 | 14718 | AGTATGGCCTTACTTT | 76 | P | 1190 |
| 1342664 | N/A | N/A | 3620 | 3635 | CAAACCAGTAACCAGG | 23 | P | 1191 |
| 1342666 | 357 | 372 | 14051 | 14066 | CGATGATACAGATCAG | 48 | P | 1192 |
| 1342682 | N/A | N/A | 7587 | 7602 | CCATTAGGCAACTCTA | 55 | P | 1193 |
| 1342691 | 472 | 487 | 14166 | 14181 | CAGGAAGTGGTCTGTT | 34 | P | 1194 |
| 1342693 | 306 | 321 | 14000 | 14015 | ATAGATTCTGTAGCTT | 51 | P | 1195 |
| 1342700 | N/A | N/A | 4210 | 4225 | TAGGCATTAATAGGCA | 25 | P | 1196 |
| 1342706 | N/A | N/A | 5931 | 5946 | GCTTAATAACTAAGGG | 68 | P | 1197 |
| 1342715 | N/A | N/A | 12082 | 12097 | TAAGTACTGAAGACTG | 75 | P | 1198 |
| 1342720 | N/A | N/A | 11144 | 11159 | ATATCCAGAGGAGTGT | 90 | P | 1199 |
| 1342724 | 191 | 206 | 13885 | 13900 | CTGAAGTTTTAAGTGG | 32† | P | 1200 |
| 1342745 | N/A | N/A | 13821 | 13836 | CTTTTAGGTAGCCTGG | 23† | P | 1201 |
| 1342770 | N/A | N/A | 5414 | 5429 | CTAATTTGGAGAGGTA | 23 | P | 1202 |
| 1342778 | 1875 | 1890 | 15569 | 15584 | ACAAGGGCTTGAATTG | 108 | P | 1203 |
| 1342795 | N/A | N/A | 4860 | 4875 | GCTAAGGGTAAGTTTA | 63 | P | 1204 |
| 1342805 | 1106 | 1121 | 14800 | 14815 | GATCATATGTCTTAGA | 24 | P | 1205 |
| 1342819 | N/A | N/A | 6098 | 6113 | TGTGAAAGTTTTGAGG | 19 | P | 1206 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342827 | 651 | 666 | 14345 | 14360 | GGATAGAAATTTGTGA | 26 | P | 1207 |
| 1342834 | N/A | N/A | 8163 | 8178 | TTCGATGGAAAGCATA | 48 | P | 1208 |
| 1342835 | N/A | N/A | 4750 | 4765 | CAATTTGAAGTGTGAG | 36 | P | 1209 |
| 1342849 | N/A | N/A | 6554 | 6569 | TATATTGTCTGTAGGT | 17 | P | 1210 |
| 1342864 | N/A | N/A | 6365 | 6380 | ATAAATATACCCCCTA | 83 | P | 1211 |
| 1342891 | N/A | N/A | 4958 | 4973 | GAACTAGTTGGGACAC | 44 | P | 1212 |
| 1342897 | N/A | N/A | 8628 | 8643 | GACCAAAAATAGTATC | 58 | P | 1213 |
| 1342899 | N/A | N/A | 6187 | 6202 | CAGAATTACTCTGGGT | 34 | P | 1214 |
| 1342912 | 398 | 413 | 14092 | 14107 | TGCAGATCTAGAGGTT | 31 | P | 1215 |
| 1342923 | 1212 | 1227 | 14906 | 14921 | AGATAATTCACTACAG | 38 | P | 1216 |
| 1342933 | N/A | N/A | 9647 | 9662 | CTATATGAGGATATCT | 103 | P | 1217 |
| 1342934 | N/A | N/A | 13493 | 13508 | TTACTACAAGTATTGG | 134 | P | 1218 |
| 1342970 | N/A | N/A | 5557 | 5572 | GAATAGGGATGCAGTA | 43 | P | 1219 |
| 1342972 | N/A | N/A | 4622 | 4637 | ACAATTAGGATACCTC | 29 | P | 1220 |
| 1342985 | N/A | N/A | 12721 | 12736 | CGATAATAATTTGTAT | 148 | P | 1221 |
| 1342990 | N/A | N/A | 6834 | 6849 | CCTAATACTAAACTTG | 88 | P | 1222 |
| 1342991 | 1545 | 1560 | 15239 | 15254 | ATAGTAGGCTATTAGG | 43 | P | 1223 |
| 1343025 | N/A | N/A | 3409 | 3424 | AATTACCAAAGTCAGC | 82 | P | 1224 |
| 1343040 | N/A | N/A | 3807 | 3822 | TCAGATGTAAATAGCT | 23 | P | 1225 |
| 1343082 | N/A | N/A | 7516 | 7531 | ATATATCAACTCCTTC | 101 | P | 1226 |
| 1343089 | N/A | N/A | 7123 | 7138 | ATCTAAGGCTACAGTC | 69 | P | 1227 |
| 1343093 | 71 | 86 | 3333 | 3348 | AAGTCTTACGGGTGTT | 21 | P | 1228 |
| 1343111 | N/A | N/A | 5133 | 5148 | GTAAAGCAAGTACTCT | 49 | P | 1229 |
| 1343114 | N/A | N/A | 7876 | 7891 | TGTTAGGAGTTTGGGT | 39 | P | 1230 |
| 1343162 | N/A | N/A | 5695 | 5710 | CTTTAAGCCATGCTGA | 93 | P | 1231 |
| 1343163 | 548 | 563 | 14242 | 14257 | TCCAACAGATGAATAC | 29 | P | 1232 |
| 1343164 | 2120 | 2135 | 15814 | 15829 | TACCAAAGTTTGGTGA | 99 | P | 1233 |
| 1343172 | 922 | 937 | 14616 | 14631 | ATGTAGATTCTGATAG | 31 | P | 1234 |
| 1343175 | N/A | N/A | 11742 | 11757 | CAGTAATTAACTGCCA | 88 | P | 1235 |
| 1343181 | N/A | N/A | 8818 | 8833 | CTGAACTAGGCTTTGT | 52 | P | 1236 |
| 1343212 | N/A | N/A | 12286 | 12301 | TGTATTAATAGCTCCA | 27 | P | 1237 |
| 1343218 | 2363 | 2378 | 16057 | 16072 | AATTTAATAGTGTCTC | 79 | P | 1238 |
| 1121455 | 1506 | 1521 | 15200 | 15215 | GAATTGTCAGCTCCCC | 7 | Q | 198 |
| 1342187 | N/A | N/A | 8353 | 8368 | GAAAACCTTTGTTGTG | 72 | Q | 1239 |
| 1342193 | N/A | N/A | 6833 | 6848 | CTAATACTAAACTTGG | 90 | Q | 1240 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342217 | 471 | 486 | 14165 | 14180 | AGGAAGTGGTCTGTTA | 26 | Q | 1241 |
| 1342222 | N/A | N/A | 9646 | 9661 | TATATGAGGATATCTG | 75 | Q | 1242 |
| 1342226 | N/A | N/A | 11993 | 12008 | ATAGTAGTAGTTTCCA | 18 | Q | 1243 |
| 1342239 | N/A | N/A | 7564 | 7579 | GACTAATGTCATATAC | 84 | Q | 1244 |
| 1342240 | N/A | N/A | 6647 | 6662 | CATGTTAAAGCTCTGT | 41 | Q | 1245 |
| 1342255 | 1104 | 1119 | 14798 | 14813 | TCATATGTCTTAGAAC | 40 | O | 1246 |
| 1342266 | N/A | N/A | 11414 | 11429 | TTATATAGTAGACTGG | 31 | Q | 1247 |
| 1342276 | N/A | N/A | 5404 | 5419 | GAGGTAACTAGACTTT | 59 | Q | 1248 |
| 1342312 | N/A | N/A | 4957 | 4972 | AACTAGTTGGGACACA | 30 | Q | 1249 |
| 1342313 | N/A | N/A | 3406 | 3421 | TACCAAAGTCAGCGAA | 113 | Q | 1250 |
| 1342318 | N/A | N/A | 11529 | 11544 | AAGGTAAGTATCAGGC | 26 | Q | 1251 |
| 1342322 | N/A | N/A | 12915 | 12930 | AGTGAGTAACAGTGGT | 30 | O | 1252 |
| 1342328 | 649 | 664 | 14343 | 14358 | ATAGAAATTTGTGAGC | 31 | Q | 1253 |
| 1342348 | N/A | N/A | 12285 | 12300 | GTATTAATAGCTCCAG | 20 | Q | 1254 |
| 1342392 | 1210 | 1225 | 14904 | 14919 | ATAATTCACTACAGTG | 43 | O | 1255 |
| 1342403 | 2177 | 2192 | 15871 | 15886 | ATGCAGTATAGGTGTA | 63 | Q | 1256 |
| 1342409 | N/A | N/A | 8090 | 8105 | TCTAATCATAAATAGT | 98 | Q | 1257 |
| 1342410 | 785 | 800 | 14479 | 14494 | GTATTAAAGAAGCTTT | 48 | Q | 1258 |
| 1342439 | N/A | N/A | 13820 | 13835 | TTTTAGGTAGCCTGGA | 77† | Q | 1259 |
| 1342442 | N/A | N/A | 7470 | 7485 | TGTTTTAGCAATGTAA | 74 | Q | 1260 |
| 1342446 | N/A | N/A | 6907 | 6922 | ATCATTAGATTTACGA | 49 | Q | 1261 |
| 1342457 | 541 | 556 | 14235 | 14250 | GATGAATACATATGGT | 15 | Q | 1262 |
| 1342462 | N/A | N/A | 3619 | 3634 | AAACCAGTAACCAGGA | 29 | Q | 1263 |
| 1342481 | 1274 | 1289 | 14968 | 14983 | CTGAAGTCTTAAGGTT | 22 | Q | 1264 |
| 1342489 | N/A | N/A | 9523 | 9538 | TAATTGGTATGCTTCA | 28 | Q | 1265 |
| 1342491 | N/A | N/A | 7122 | 7137 | TCTAAGGCTACAGTCT | 52 | Q | 1266 |
| 1342526 | N/A | N/A | 11130 | 11145 | GTAAATCTTTCTGCCG | 70 | Q | 1267 |
| 1342556 | 189 | 204 | 13883 | 13898 | GAAGTTTTAAGTGGTC | 6† | Q | 1268 |
| 1342569 | 921 | 936 | 14615 | 14630 | TGTAGATTCTGATAGT | 12 | Q | 1269 |
| 1342573 | N/A | N/A | 11727 | 11742 | AGACATAGTGACTGTT | 72 | Q | 1270 |
| 1342580 | N/A | N/A | 13492 | 13507 | TACTACAAGTATTGGA | 95 | Q | 1271 |
| 1342629 | 1074 | 1089 | 14768 | 14783 | CCTACATGTACTAGAA | 24 | Q | 1272 |
| 1342639 | 396 | 411 | 14090 | 14105 | CAGATCTAGAGGTTGT | 16 | Q | 1273 |
| 1342656 | N/A | N/A | 6972 | 6987 | GATAAGCCATAAGTGA | 55 | Q | 1274 |
| 1342661 | N/A | N/A | 3806 | 3821 | CAGATGTAAATAGCTC | 26 | Q | 1275 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342662 | 1156 | 1171 | 14850 | 14865 | TGATATGACTAATCTC | 69 | Q | 1276 |
| 1342670 | 1458 | 1473 | 15152 | 15167 | TAATAGATGGGCCAAC | 66 | Q | 1277 |
| 1342676 | 1937 | 1952 | 15631 | 15646 | TTACCATTTGGTTGAT | 55 | Q | 1278 |
| 1342681 | 1513 | 1528 | 15207 | 15222 | GACCCACGAATTGTCA | 105 | Q | 1279 |
| 1342699 | 1002 | 1017 | 14696 | 14711 | CCTTACTTTTCCATAC | 34 | Q | 1280 |
| 1342712 | N/A | N/A | 12585 | 12600 | GATACACTCATGTACA | 107 | Q | 1281 |
| 1342714 | N/A | N/A | 4208 | 4223 | GGCATTAATAGGCAGA | 23 | Q | 1282 |
| 1342730 | N/A | N/A | 5127 | 5142 | CAAGTACTCTGGCTCT | 29 | Q | 1283 |
| 1342748 | 1868 | 1883 | 15562 | 15577 | CTTGAATTGCAAGGGT | 51 | Q | 1284 |
| 1342774 | N/A | N/A | 5694 | 5709 | TTTAAGCCATGCTGAT | 75 | Q | 1285 |
| 1342799 | N/A | N/A | 4621 | 4636 | CAATTAGGATACCTCA | 35 | Q | 1286 |
| 1342802 | N/A | N/A | 10443 | 10458 | ATATTTGAGTAGTCAC | 56 | Q | 1287 |
| 1342803 | N/A | N/A | 6546 | 6561 | CTGTAGGTTTGCCTTC | 32 | Q | 1288 |
| 1342811 | N/A | N/A | 12389 | 12404 | TTTAAGGTACAGCTTG | 92 | Q | 1289 |
| 1342826 | N/A | N/A | 8627 | 8642 | ACCAAAAATAGTATCC | 60 | Q | 1290 |
| 1342840 | N/A | N/A | 7354 | 7369 | TGTATATGCTGAGCAT | 24 | Q | 1291 |
| 1342856 | N/A | N/A | 12081 | 12096 | AAGTACTGAAGACTGT | 93 | Q | 1292 |
| 1342875 | 1720 | 1735 | 15414 | 15429 | TTTTATGTTGACCCAC | 26 | Q | 1293 |
| 1342887 | N/A | N/A | 7862 | 7877 | GTGTAGAAATGCCAGA | 17 | Q | 1294 |
| 1342921 | N/A | N/A | 6185 | 6200 | GAATTACTCTGGGTAA | 69 | Q | 1295 |
| 1342938 | N/A | N/A | 5547 | 5562 | GCAGTATCAAATATAT | 43 | Q | 1296 |
| 1342976 | N/A | N/A | 10721 | 10736 | CATACAACAAGCTCCC | 74 | Q | 1297 |
| 1342987 | N/A | N/A | 6354 | 6369 | CCCTATTAATGTGAGT | 74 | Q | 1298 |
| 1342995 | N/A | N/A | 6092 | 6107 | AGTTTTGAGGAGATGT | 61 | Q | 1299 |
| 1343011 | N/A | N/A | 4367 | 4382 | GAGGATTGTAACATAA | 16 | Q | 1300 |
| 1343016 | 355 | 370 | 14049 | 14064 | ATGATACAGATCAGCA | 68 | Q | 1301 |
| 1343028 | 2119 | 2134 | 15813 | 15828 | ACCAAAGTTTGGTGAA | 85 | Q | 1302 |
| 1343029 | N/A | N/A | 3861 | 3876 | GAATAGGCATGCTGAT | 61 | Q | 1303 |
| 1343071 | 16 | 31 | 3278 | 3293 | GAACAGTTGCAGTAGG | 41 | Q | 1304 |
| 1343078 | N/A | N/A | 8777 | 8792 | AATACAGAGATATGCC | 50 | Q | 1305 |
| 1343092 | N/A | N/A | 5930 | 5945 | CTTAATAACTAAGGGC | 49 | Q | 1306 |
| 1343113 | 282 | 297 | 13976 | 13991 | CTTGTTGAGGCATTTC | 13 | Q | 1307 |
| 1343178 | N/A | N/A | 9720 | 9735 | GAAACCTTTCATTAGT | 55 | Q | 1308 |
| 1343184 | 841 | 856 | 14535 | 14550 | TGACACTTCATTTGTG | 45 | Q | 1309 |
| 1343188 | 1238 | 1253 | 14932 | 14947 | TATGGTAAGCTAGGTA | 19 | Q | 1310 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343197 | 1988 | 2003 | 15682 | 15697 | CATAGCTGGATCTATA | 63 | Q | 1311 |
| 1343198 | N/A | N/A | 4697 | 4712 | ATAACATAAGACACCT | 30 | Q | 1312 |
| 1343206 | 1544 | 1559 | 15238 | 15253 | TAGTAGGCTATTAGGT | 31 | Q | 1313 |
| 1343207 | N/A | N/A | 4828 | 4843 | ATCCAGAAGTATGTGT | 53 | Q | 1314 |
| 1343229 | 2362 | 2377 | 16056 | 16071 | ATTTAATAGTGTCTCC | 59 | Q | 1315 |
| 1091809 | 2734 | 2749 | 16428 | 16443 | GAGTTATAGTATTCTG | 46 | R | 1316 |
| 1121455 | 1506 | 1521 | 15200 | 15215 | GAATTGTCAGCTCCCC | 6 | R | 198 |
| 1342168 | N/A | N/A | 7464 | 7479 | AGCAATGTAATATCAG | 23 | R | 1317 |
| 1342189 | 1154 | 1169 | 14848 | 14863 | ATATGACTAATCTCAC | 48 | R | 1318 |
| 1342190 | 920 | 935 | 14614 | 14629 | GTAGATTCTGATAGTT | 6 | R | 1319 |
| 1342196 | N/A | N/A | 8089 | 8104 | CTAATCATAAATAGTT | 101 | R | 1320 |
| 1342199 | 184 | 199 | 13878 | 13893 | TTTAAGTGGTCGAGAG | 6† | R | 1321 |
| 1342202 | 1987 | 2002 | 15681 | 15696 | ATAGCTGGATCTATAA | 76 | R | 1322 |
| 1342206 | N/A | N/A | 6831 | 6846 | AATACTAAACTTGGAC | 93 | R | 1323 |
| 1342214 | 279 | 294 | 13973 | 13988 | GTTGAGGCATTTCAAT | 69 | R | 1324 |
| 1342219 | N/A | N/A | 5929 | 5944 | TTAATAACTAAGGGCA | 66 | R | 1325 |
| 1342252 | N/A | N/A | 13491 | 13506 | ACTACAAGTATTGGAG | 90 | R | 1326 |
| 1342257 | N/A | N/A | 6968 | 6983 | AGCCATAAGTGAATGT | 44 | R | 1327 |
| 1342263 | N/A | N/A | 11413 | 11428 | TATATAGTAGACTGGG | 40 | R | 1328 |
| 1342275 | N/A | N/A | 4946 | 4961 | ACACAATGTATGGTAC | 59 | R | 1329 |
| 1342285 | N/A | N/A | 5402 | 5417 | GGTAACTAGACTTTAG | 22 | R | 1330 |
| 1342311 | 395 | 410 | 14089 | 14104 | AGATCTAGAGGTTGTA | 26 | R | 1331 |
| 1342333 | 840 | 855 | 14534 | 14549 | GACACTTCATTTGTGT | 92 | R | 1332 |
| 1342334 | N/A | N/A | 6502 | 6517 | GCTTTACAAGTGTATT | 19 | R | 1333 |
| 1342355 | 749 | 764 | 14443 | 14458 | ATTCACCTCAAAAGAG | 69 | R | 1334 |
| 1342356 | N/A | N/A | 7860 | 7875 | GTAGAAATGCCAGACT | 38 | R | 1335 |
| 1342357 | N/A | N/A | 3850 | 3865 | CTGATAATGTGCATGT | 28 | R | 1336 |
| 1342358 | N/A | N/A | 6906 | 6921 | TCATTAGATTTACGAT | 69 | R | 1337 |
| 1342394 | N/A | N/A | 9630 | 9645 | TCAGATTATAGCACAA | 53 | R | 1338 |
| 1342399 | N/A | N/A | 6646 | 6661 | ATGTTAAAGCTCTGTC | 29 | R | 1339 |
| 1342459 | N/A | N/A | 8352 | 8367 | AAAACCTTTGTTGTGG | 52 | R | 1340 |
| 1342493 | N/A | N/A | 10117 | 10132 | GAAGATGTGTAGCAGA | 14 | R | 1341 |
| 1342503 | 1237 | 1252 | 14931 | 14946 | ATGGTAAGCTAGGTAA | 27 | R | 1342 |
| 1342518 | N/A | N/A | 3618 | 3633 | AACCAGTAACCAGGAT | 47 | R | 1343 |
| 1342535 | N/A | N/A | 7563 | 7578 | ACTAATGTCATATACC | 22 | R | 1344 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1342545 | N/A | N/A | 11992 | 12007 | TAGTAGTAGTTTCCAT | 45 | R | 1345 |
| 1342554 | N/A | N/A | 8776 | 8791 | ATACAGAGATATGCCC | 53 | R | 1346 |
| 1342584 | 998 | 1013 | 14692 | 14707 | ACTTTTCCATACTTGA | 19 | R | 1347 |
| 1342587 | 1456 | 1471 | 15150 | 15165 | ATAGATGGGCCAACAA | 70 | R | 1348 |
| 1342615 | N/A | N/A | 7120 | 7135 | TAAGGCTACAGTCTGA | 72 | R | 1349 |
| 1342617 | N/A | N/A | 12388 | 12403 | TTAAGGTACAGCTTGT | 66 | R | 1350 |
| 1342621 | N/A | N/A | 5024 | 5039 | CTTACTTTGAAACCAC | 20 | R | 1351 |
| 1342640 | N/A | N/A | 11726 | 11741 | GACATAGTGACTGTTA | 67 | R | 1352 |
| 1342657 | 354 | 369 | 14048 | 14063 | TGATACAGATCAGCAA | 61 | R | 1353 |
| 1342703 | N/A | N/A | 9711 | 9726 | CATTAGTTATTAAGGT | 110 | R | 1354 |
| 1342705 | N/A | N/A | 3805 | 3820 | AGATGTAAATAGCTCA | 11 | R | 1355 |
| 1342721 | N/A | N/A | 6352 | 6367 | CTATTAATGTGAGTGA | 56 | R | 1356 |
| 1342742 | N/A | N/A | 4620 | 4635 | AATTAGGATACCTCAG | 38 | R | 1357 |
| 1342747 | N/A | N/A | 7353 | 7368 | GTATATGCTGAGCATT | 44 | R | 1358 |
| 1342786 | N/A | N/A | 12551 | 12566 | GACAACTTAAACATGC | 32 | R | 1359 |
| 1342787 | 648 | 663 | 14342 | 14357 | TAGAAATTTGTGAGCC | 19 | R | 1360 |
| 1342789 | N/A | N/A | 3405 | 3420 | ACCAAAGTCAGCGAAA | 73 | R | 1361 |
| 1342797 | 1936 | 1951 | 15630 | 15645 | TACCATTTGGTTGATA | 67 | R | 1362 |
| 1342798 | 1866 | 1881 | 15560 | 15575 | TGAATTGCAAGGGTCC | 32 | R | 1363 |
| 1342804 | N/A | N/A | 12912 | 12927 | GAGTAACAGTGGTTGT | 81 | R | 1364 |
| 1342828 | N/A | N/A | 10720 | 10735 | ATACAACAAGCTCCCC | 64 | R | 1365 |
| 1342832 | 1103 | 1118 | 14797 | 14812 | CATATGTCTTAGAACA | 52 | R | 1366 |
| 1342843 | 1542 | 1557 | 15236 | 15251 | GTAGGCTATTAGGTAG | 19 | R | 1367 |
| 1342851 | 469 | 484 | 14163 | 14178 | GAAGTGGTCTGTTATA | 23 | R | 1368 |
| 1342863 | 2118 | 2133 | 15812 | 15827 | CCAAAGTTTGGTGAAT | 56 | R | 1369 |
| 1342870 | N/A | N/A | 6176 | 6191 | TGGGTAAGAACTTTGA | 40 | R | 1370 |
| 1342884 | 1207 | 1222 | 14901 | 14916 | ATTCACTACAGTGCCT | 39 | R | 1371 |
| 1342886 | N/A | N/A | 11118 | 11133 | GCCGTAAAGACATACA | 88 | R | 1372 |
| 1342900 | N/A | N/A | 6076 | 6091 | TAACTTGGATTTTAGG | 56 | R | 1373 |
| 1342905 | 1508 | 1523 | 15202 | 15217 | ACGAATTGTCAGCTCC | 14 | R | 1374 |
| 1342928 | N/A | N/A | 12283 | 12298 | ATTAATAGCTCCAGAG | 92 | R | 1375 |
| 1342936 | 1717 | 1732 | 15411 | 15426 | TATGTTGACCCACTTC | 26 | R | 1376 |
| 1342958 | N/A | N/A | 13819 | 13834 | TTTAGGTAGCCTGGAA | 69† | R | 1377 |
| 1343000 | N/A | N/A | 4696 | 4711 | TAACATAAGACACCTA | 74 | R | 1378 |
| 1343005 | N/A | N/A | 11527 | 11542 | GGTAAGTATCAGGCAT | 42 | R | 1379 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343014 | N/A | N/A | 5678 | 5693 | CAGTATATAGAGGATG | 24 | R | 1380 |
| 1343035 | N/A | N/A | 5534 | 5549 | TATAATTAAGAGGACC | 61 | R | 1381 |
| 1343037 | N/A | N/A | 4350 | 4365 | GAATAGGGTAGAATTC | 108 | R | 1382 |
| 1343079 | 1073 | 1088 | 14767 | 14782 | CTACATGTACTAGAAT | 80 | R | 1383 |
| 1343087 | N/A | N/A | 8621 | 8636 | AATAGTATCCTGTTTC | 37 | R | 1384 |
| 1343090 | N/A | N/A | 4826 | 4841 | CCAGAAGTATGTGTAC | 42 | R | 1385 |
| 1343140 | 538 | 553 | 14232 | 14247 | GAATACATATGGTAAC | 103 | R | 1386 |
| 1343159 | N/A | N/A | 12080 | 12095 | AGTACTGAAGACTGTC | 75 | R | 1387 |
| 1343182 | N/A | N/A | 4207 | 4222 | GCATTAATAGGCAGAA | 23 | R | 1388 |
| 1343183 | 2176 | 2191 | 15870 | 15885 | TGCAGTATAGGTGTAA | 56 | R | 1389 |
| 1343186 | N/A | N/A | 9474 | 9489 | GACTAAAACTATTAGA | 106 | R | 1390 |
| 1343190 | 1272 | 1287 | 14966 | 14981 | GAAGTCTTAAGGTTTC | 56 | R | 1391 |
| 1343219 | 2306 | 2321 | 16000 | 16015 | TCAATATTGATGTTAC | 45 | R | 1392 |
| 1121455 | 1506 | 1521 | 15200 | 15215 | GAATTGTCAGCTCCCC | 21 | S | 198 |
| 1121455 | 1506 | 1521 | 15200 | 15215 | GAATTGTCAGCTCCCC | 18 | T | 198 |
| 1121455 | 1506 | 1521 | 15200 | 15215 | GAATTGTCAGCTCCCC | 18 | U | 198 |
| 1121455 | 1506 | 1521 | 15200 | 15215 | GAATTGTCAGCTCCCC | 19 | V | 198 |
| 1121455 | 1506 | 1521 | 15200 | 15215 | GAATTGTCAGCTCCCC | 15 | W | 198 |
| 1121455 | 1506 | 1521 | 15200 | 15215 | GAATTGTCAGCTCCCC | 15 | X | 198 |
| 1343141 | 822 | 837 | 14516 | 14531 | TTACTTTGATACTTGG | 7 | AA | 612 |
| 1393351 | N/A | N/A | 7362 | 7377 | AATGATGTTGTATATG | 77 | AA | 1393 |
| 1393352 | N/A | N/A | 3808 | 3823 | TTCAGATGTAAATAGC | 34 | AA | 1394 |
| 1393353 | 557 | 572 | 14251 | 14266 | TTTACAAGATCCAACA | 65 | AA | 1395 |
| 1393355 | N/A | N/A | 5498 | 5513 | CGAGTATATTAGGAAA | 36 | AA | 1396 |
| 1393359 | 1609 | 1624 | 15303 | 15318 | ATACATATAACACGCA | 25 | AA | 1397 |
| 1393361 | 1611 | 1626 | 15305 | 15320 | TAATACATATAACACG | 92 | AA | 1398 |
| 1393362 | N/A | N/A | 5497 | 5512 | GAGTATATTAGGAAAT | 90 | AA | 1399 |
| 1343141 | 822 | 837 | 14516 | 14531 | TTACTTTGATACTTGG | 4 | AB | 612 |
| 1393365 | N/A | N/A | 4544 | 4559 | TTCTTATTTGTAGTGA | 35 | AB | 1400 |
| 1393368 | N/A | N/A | 4545 | 4560 | GTTCTTATTTGTAGTG | 28 | AB | 1401 |
| 1393374 | N/A | N/A | 7865 | 7880 | TGGGTGTAGAAATGCC | 27 | AB | 1402 |
| 1393375 | 1528 | 1543 | 15222 | 15237 | AGTTAAGATTTTGCGG | 20 | AB | 1403 |
| 1393376 | N/A | N/A | 7861 | 7876 | TGTAGAAATGCCAGAC | 17 | AB | 1404 |
| 1393377 | N/A | N/A | 4515 | 4530 | CATTTGTCATAGGAAT | 38 | AB | 1405 |
| 1393378 | 1505 | 1520 | 15199 | 15214 | AATTGTCAGCTCCCCT | 17 | AB | 1406 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393379 | 876 | 891 | 14570 | 14585 | ACAGATGTGAGGAGTC | 14 | AB | 1407 |
| 1393380 | N/A | N/A | 7863 | 7878 | GGTGTAGAAATGCCAG | 50 | AB | 1408 |
| 1393381 | N/A | N/A | 7864 | 7879 | GGGTGTAGAAATGCCA | 65 | AB | 1409 |
| 1393382 | 1316 | 1331 | 15010 | 15025 | TTGGATGTTAGGCTGG | 8 | AB | 1410 |
| 1393383 | 875 | 890 | 14569 | 14584 | CAGATGTGAGGAGTCA | 17 | AB | 1411 |
| 1393384 | 526 | 541 | 14220 | 14235 | TAACAATAAGTTTTAG | 96 | AB | 1412 |
| 1393385 | N/A | N/A | 5504 | 5519 | TGTACACGAGTATATT | 33 | AB | 1413 |
| 1393386 | 531 | 546 | 14225 | 14240 | TATGGTAACAATAAGT | 51 | AB | 1414 |
| 1393387 | N/A | N/A | 4517 | 4532 | AACATTTGTCATAGGA | 4 | AB | 1415 |
| 1393388 | 89 | 104 | 3351 | 3366 | AGAGTATTGTGTTGTA | 6 | AB | 1416 |
| 1393389 | N/A | N/A | 11990 | 12005 | GTAGTAGTTTCCATCA | 44 | AB | 1417 |
| 1393390 | 530 | 545 | 14224 | 14239 | ATGGTAACAATAAGTT | 28 | AB | 1418 |
| 1393391 | 90 | 105 | 3352 | 3367 | TAGAGTATTGTGTTGT | 6 | AB | 1419 |
| 1393392 | N/A | N/A | 4516 | 4531 | ACATTTGTCATAGGAA | 17 | AB | 1420 |
| 1393393 | N/A | N/A | 5503 | 5518 | GTACACGAGTATATTA | 28 | AB | 1421 |
| 1393398 | N/A | N/A | 11991 | 12006 | AGTAGTAGTTTCCATC | 15 | AB | 1422 |
| 1393402 | 1251 | 1266 | 14945 | 14960 | TCCAAAGATATAGTAT | 33 | AB | 1423 |
| 1393403 | 1543 | 1558 | 15237 | 15252 | AGTAGGCTATTAGGTA | 12 | AB | 1424 |
| 1393407 | N/A | N/A | 11995 | 12010 | TAATAGTAGTAGTTTC | 68 | AB | 1425 |
| 1393440 | 1262 | 1277 | 14956 | 14971 | GGTTTCATGATTCCAA | 9 | AB | 1426 |
| 1393444 | 1263 | 1278 | 14957 | 14972 | AGGTTTCATGATTCCA | 11 | AB | 1427 |
| 1393470 | 1266 | 1281 | 14960 | 14975 | TTAAGGTTTCATGATT | 31 | AB | 1428 |
| 1393497 | 623 | 638 | 14317 | 14332 | AAATCAACAGTTGCAT | 38 | AB | 1429 |
| 1393531 | 627 | 642 | 14321 | 14336 | GAGGAAATCAACAGTT | 14 | AB | 1430 |
| 1393549 | N/A | N/A | 7282 | 7297 | GTATTTTTGGTGGTAT | 10 | AB | 1431 |
| 1393556 | N/A | N/A | 7283 | 7298 | AGTATTTTTGGTGGTA | 6 | AB | 1432 |
| 1393576 | N/A | N/A | 7286 | 7301 | TTCAGTATTTTTGGTG | 30 | AB | 1433 |
| 1393580 | N/A | N/A | 7285 | 7300 | TCAGTATTTTTGGTGG | 49 | AB | 1434 |
| 1393582 | N/A | N/A | 7287 | 7302 | CTTCAGTATTTTTGGT | 45 | AB | 1435 |
| 1393587 | N/A | N/A | 12085 | 12100 | TGTTAAGTACTGAAGA | 60 | AB | 1436 |
| 1393597 | N/A | N/A | 12086 | 12101 | ATGTTAAGTACTGAAG | 66 | AB | 1437 |
| 1393605 | N/A | N/A | 12088 | 12103 | TGATGTTAAGTACTGA | 20 | AB | 1438 |
| 1393632 | N/A | N/A | 12090 | 12105 | TTTGATGTTAAGTACT | 59 | AB | 1439 |
| 1393651 | 539 | 554 | 14233 | 14248 | TGAATACATATGGTAA | 39 | AB | 1440 |
| 1393702 | N/A | N/A | 7560 | 7575 | AATGTCATATACCATG | 65 | AB | 1441 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393711 | N/A | N/A | 7561 | 7576 | TAATGTCATATACCAT | 48 | AB | 1442 |
| 1393734 | N/A | N/A | 7565 | 7580 | TGACTAATGTCATATA | 84 | AB | 1443 |
| 1393751 | N/A | N/A | 7566 | 7581 | TTGACTAATGTCATAT | 86 | AB | 1444 |
| 1393767 | 1566 | 1581 | 15260 | 15275 | TATCAGTAAGGTTTAT | 51 | AB | 1445 |
| 1393790 | 1271 | 1286 | 14965 | 14980 | AAGTCTTAAGGTTTCA | 14 | AB | 1446 |
| 1393805 | N/A | N/A | 5847 | 5862 | TGTAATGCTATGCATA | 29 | AB | 1447 |
| 1393817 | N/A | N/A | 5848 | 5863 | ATGTAATGCTATGCAT | 87 | AB | 1448 |
| 1393834 | N/A | N/A | 5851 | 5866 | AGAATGTAATGCTATG | 33 | AB | 1449 |
| 1393876 | 1318 | 1333 | 15012 | 15027 | CATTGGATGTTAGGCT | 17 | AB | 1450 |
| 1393884 | N/A | N/A | 6941 | 6956 | TTTTTGGACTTGTGGT | 21 | AB | 1451 |
| 1393921 | N/A | N/A | 6944 | 6959 | CCTTTTTTGGACTTGT | 6 | AB | 1452 |
| 1393923 | N/A | N/A | 6945 | 6960 | CCCTTTTTTGGACTTG | 7 | AB | 1453 |
| 1393926 | N/A | N/A | 7356 | 7371 | GTTGTATATGCTGAGC | 4 | AB | 1454 |
| 1393953 | N/A | N/A | 7358 | 7373 | ATGTTGTATATGCTGA | 10 | AB | 1455 |
| 1393964 | N/A | N/A | 11998 | 12013 | ACTTAATAGTAGTAGT | 73 | AB | 1456 |
| 1393989 | N/A | N/A | 7279 | 7294 | TTTTTGGTGGTATTCC | 14 | AB | 1457 |
| 1394015 | N/A | N/A | 12092 | 12107 | GATTTGATGTTAAGTA | 38 | AB | 1458 |
| 1394018 | N/A | N/A | 7558 | 7573 | TGTCATATACCATGTT | 22 | AB | 1459 |
| 1394035 | N/A | N/A | 7568 | 7583 | TTTTGACTAATGTCAT | 74 | AB | 1460 |
| 1394055 | N/A | N/A | 5845 | 5860 | TAATGCTATGCATAAA | 76 | AB | 1461 |
| 1394059 | N/A | N/A | 5855 | 5870 | ATTAAGAATGTAATGC | 56 | AB | 1462 |
| 1394075 | N/A | N/A | 6947 | 6962 | TACCCTTTTTTGGACT | 44 | AB | 1463 |
| 1394098 | N/A | N/A | 5411 | 5426 | ATTTGGAGAGGTAACT | 56 | AB | 1464 |
| 1394099 | N/A | N/A | 3811 | 3826 | TAGTTCAGATGTAAAT | 84 | AB | 1465 |
| 1394100 | 1605 | 1620 | 15299 | 15314 | ATATAACACGCAAAAT | 83 | AB | 1466 |
| 1394101 | N/A | N/A | 5421 | 5436 | ATATTGTCTAATTTGG | 40 | AB | 1467 |
| 1394103 | N/A | N/A | 5494 | 5509 | TATATTAGGAAATTGC | 35 | AB | 1468 |
| 1394104 | 643 | 658 | 14337 | 14352 | ATTTGTGAGCCATGTT | 13 | AB | 1469 |
| 1394106 | N/A | N/A | 4238 | 4253 | ACTGGAGGATAATAAC | 73 | AB | 1470 |
| 1394108 | N/A | N/A | 5505 | 5520 | GTGTACACGAGTATAT | 33 | AB | 1471 |
| 1394109 | N/A | N/A | 5495 | 5510 | GTATATTAGGAAATTG | 78 | AB | 1472 |
| 1394110 | N/A | N/A | 7857 | 7872 | GAAATGCCAGACTCCT | 41 | AB | 1473 |
| 1394111 | 523 | 538 | 14217 | 14232 | CAATAAGTTTTAGTCT | 100 | AB | 1474 |
| 1394112 | 1309 | 1324 | 15003 | 15018 | TTAGGCTGGAATGGAA | 26 | AB | 1475 |
| 1394113 | N/A | N/A | 4537 | 4552 | TTGTAGTGAGCAATAG | 19 | AB | 1476 |

TABLE 2-continued

Reduction of PLN RNA by 3-10-3 cEt modified oligonucleotides with uniform phosphorothioate internucleoside linkages at a concentration of 6000 nM in iCell ® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343141 | 822 | 837 | 14516 | 14531 | TTACTTTGATACTTGG | 7 | Y | 612 |
| 1343141 | 822 | 837 | 14516 | 14531 | TTACTTTGATACTTGG | 6 | Z | 612 |
| 1343141 | 822 | 837 | 14516 | 14531 | TTACTTTGATACTTGG | 3 | AC | 612 |
| 1393354 | N/A | N/A | 4236 | 4251 | TGGAGGATAATAACTT | 26 | AC | 1477 |
| 1393356 | N/A | N/A | 4235 | 4250 | GGAGGATAATAACTTG | 30 | AC | 1478 |
| 1393357 | N/A | N/A | 5413 | 5428 | TAATTTGGAGAGGTAA | 75 | AC | 1479 |
| 1393358 | N/A | N/A | 4231 | 4246 | GATAATAACTTGACAA | 59 | AC | 1480 |
| 1393360 | N/A | N/A | 5418 | 5433 | TTGTCTAATTTGGAGA | 64 | AC | 1481 |
| 1393363 | N/A | N/A | 5417 | 5432 | TGTCTAATTTGGAGAG | 50 | AC | 1482 |
| 1393364 | N/A | N/A | 5419 | 5434 | ATTGTCTAATTTGGAG | 36 | AC | 1483 |
| 1343141 | 822 | 837 | 14516 | 14531 | TTACTTTGATACTTGG | 4 | AD | 612 |
| 1393366 | N/A | N/A | 4540 | 4555 | TATTTGTAGTGAGCAA | 25 | AD | 1484 |
| 1393367 | 647 | 662 | 14341 | 14356 | AGAAATTTGTGAGCCA | 5 | AD | 1485 |
| 1393369 | 646 | 661 | 14340 | 14355 | GAAATTTGTGAGCCAT | 6 | AD | 1486 |
| 1393370 | 650 | 665 | 14344 | 14359 | GATAGAAATTTGTGAG | 19 | AD | 1487 |
| 1393371 | 645 | 660 | 14339 | 14354 | AAATTTGTGAGCCATG | 16 | AD | 1488 |
| 1393372 | N/A | N/A | 4541 | 4556 | TTATTTGTAGTGAGCA | 6 | AD | 1489 |
| 1393373 | N/A | N/A | 4539 | 4554 | ATTTGTAGTGAGCAAT | 39 | AD | 1490 |
| 1343141 | 822 | 837 | 14516 | 14531 | TTACTTTGATACTTGG | 4 | AE | 612 |
| 1343141 | 822 | 837 | 14516 | 14531 | TTACTTTGATACTTGG | 6 | AF | 612 |
| 1343141 | 822 | 837 | 14516 | 14531 | TTACTTTGATACTTGG | 3 | AG | 612 |
| 1343141 | 822 | 837 | 14516 | 14531 | TTACTTTGATACTTGG | 6 | AH | 612 |

Example 3: Effect of Mixed MOE and cEt, Uniform Phosphorothioate Modified Oligonucleotides on Human PLN RNA In Vitro, Single Dose Modified oligonucleotides complementary to human PLN nucleic acid were designed and tested for their single dose effects on PLN RNA in vitro. The modified oligonucleotides were tested in a series of experiments that had the same culture conditions.

The modified oligonucleotides in the table below are 16 nucleosides in length, wherein the sugar motif for the modified oligonucleotides is (from 5' to 3'): kkddddddddd-kekek; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

"Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the table below is 100% complementary to SEQ ID NO: 1 (described herein above), to SEQ ID NO: 2 (described herein above), or to both. "N/A" indicates that the modified oligonucleotide is not 100% complementary to that particular target nucleic acid sequence.

Cultured iCell® cardiomyocytes[2] (FujiFilm Cellular Dynamics, Inc.; Catalog No: R1017) were treated with modified oligonucleotide at a concentration of 6000 nM by free uptake at a density of 8,000 cells per well. After a treatment period of approximately 72 hours, total RNA was isolated from the cells and PLN RNA levels were measured by quantitative real-time RTPCR. PLN RNA levels were measured by human primer-probe set RTS40402 (described herein above). PLN RNA levels were normalized to total RNA content, as measured by RIBOGREEN® Reduction of PLN RNA is presented in the table below as percent PLN RNA relative to the amount in untreated control cells (% UTC).

Each separate experimental analysis described in this example is identified by a letter ID in the table column below labeled "AID" (Analysis ID). In the table below, Compound Nos. 1121455 and 1343141 (described herein above) were used as benchmarks.

TABLE 3

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121455 | 1506 | 1521 | 15200 | 15215 | GAATTGTCAGCTCCCC | 21 | S | 198 |
| 1343235 | 258 | 273 | 13952 | 13967 | AGGCTCTTCTTATAGC | 87 | S | 250 |
| 1343237 | 279 | 294 | 13973 | 13988 | GTTGAGGCATTTCAAT | 88 | S | 1324 |
| 1343242 | 266 | 281 | 13960 | 13975 | AATGGTTGAGGCTCTT | 107 | S | 176 |
| 1343243 | 275 | 290 | 13969 | 13984 | AGGCATTTCAATGGTT | 44 | S | 254 |
| 1343244 | 402 | 417 | 14096 | 14111 | AAGCTGCAGATCTAGA | 99 | S | 1491 |
| 1343247 | 810 | 825 | 14504 | 14519 | TTGGTGAAGACCTGAA | 82 | S | 1492 |
| 1343250 | 411 | 426 | 14105 | 14120 | TGATGTGGCAAGCTGC | 65 | S | 1493 |
| 1343254 | 1074 | 1089 | 14768 | 14783 | CCTACATGTACTAGAA | 49 | S | 1272 |
| 1343259 | 818 | 833 | 14512 | 14527 | TTTGATACTTGGTGAA | 25 | S | 794 |
| 1343261 | 1009 | 1024 | 14703 | 14718 | AGTATGGCCTTACTTT | 128 | S | 1190 |
| 1343262 | 909 | 924 | 14603 | 14618 | TAGTTACTACAAATAG | 92 | S | 795 |
| 1343263 | 920 | 935 | 14614 | 14629 | GTAGATTCTGATAGTT | 28 | S | 1319 |
| 1343268 | 1252 | 1267 | 14946 | 14961 | TTCCAAAGATATAGTA | 35 | S | 812 |
| 1343270 | 1242 | 1257 | 14936 | 14951 | ATAGTATGGTAAGCTA | 60 | S | 44 |
| 1343271 | 1130 | 1145 | 14824 | 14839 | ATTAACCACCAGTTCT | 96 | S | 263 |
| 1343272 | 1140 | 1155 | 14834 | 14849 | ACTGTCACATATTAAC | 61 | S | 1494 |
| 1343274 | 1516 | 1531 | 15210 | 15225 | GCGGACCCACGAATTG | 68 | S | 1083 |
| 1343278 | 1545 | 1560 | 15239 | 15254 | ATAGTAGGCTATTAGG | 18 | S | 1223 |
| 1343281 | 1535 | 1550 | 15229 | 15244 | ATTAGGTAGTTAAGAT | 66 | S | 126 |
| 1343284 | N/A | N/A | 3622 | 3637 | GACAAACCAGTAACCA | 64 | S | 1099 |
| 1343287 | N/A | N/A | 4204 | 4219 | TTAATAGGCAGAAATC | 91 | S | 377 |
| 1343292 | N/A | N/A | 4214 | 4229 | ACTATAGGCATTAATA | 110 | S | 938 |
| 1343293 | N/A | N/A | 3612 | 3627 | TAACCAGGATCAAAGA | 73 | S | 562 |
| 1343397 | 563 | 578 | 14257 | 14272 | TTCATGTTTACAAGAT | 69 | S | 1495 |
| 1343398 | 78 | 93 | 3340 | 3355 | TTGTATGAAGTCTTAC | 89 | S | 945 |
| 1343401 | 559 | 574 | 14253 | 14268 | TGTTTACAAGATCCAA | 25 | S | 799 |
| 1343404 | 74 | 89 | 3336 | 3351 | ATGAAGTCTTACGGGT | 80 | S | 1140 |
| 1343406 | 263 | 278 | 13957 | 13972 | GGTTGAGGCTCTTCTT | 40 | S | 251 |
| 1343408 | 271 | 286 | 13965 | 13980 | ATTTCAATGGTTGAGG | 67 | S | 253 |
| 1343410 | 269 | 284 | 13963 | 13978 | TTCAATGGTTGAGGCT | 77 | S | 104 |
| 1343411 | 273 | 288 | 13967 | 13982 | GCATTTCAATGGTTGA | 51 | S | 90 |

TABLE 3-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343417 | 406 | 421 | 14100 | 14115 | TGGCAAGCTGCAGATC | 81 | S | 108 |
| 1343419 | 372 | 387 | 14066 | 14081 | TTCAGAGAAGCATCAC | 91 | S | 697 |
| 1343420 | 399 | 414 | 14093 | 14108 | CTGCAGATCTAGAGGT | 67 | S | 1090 |
| 1343422 | 395 | 410 | 14089 | 14104 | AGATCTAGAGGTTGTA | 32 | S | 1331 |
| 1343425 | 368 | 383 | 14062 | 14077 | GAGAAGCATCACGATG | 70 | S | 788 |
| 1343429 | 821 | 836 | 14515 | 14530 | TACTTTGATACTTGGT | 23 | S | 680 |
| 1343431 | 815 | 830 | 14509 | 14524 | GATACTTGGTGAAGAC | 34 | S | 34 |
| 1343433 | 711 | 726 | 14405 | 14420 | AAGTGAACTTGTTGGC | 104 | S | 762 |
| 1343435 | 707 | 722 | 14401 | 14416 | GAACTTGTTGGCAGTG | 50 | S | 915 |
| 1343437 | 990 | 1005 | 14684 | 14699 | ATACTTGATTCTCATC | 36 | S | 647 |
| 1343439 | 913 | 928 | 14607 | 14622 | CTGATAGTTACTACAA | 36 | S | 611 |
| 1343440 | 917 | 932 | 14611 | 14626 | GATTCTGATAGTTACT | 31 | S | 457 |
| 1343442 | 915 | 930 | 14609 | 14624 | TTCTGATAGTTACTAC | 27 | S | 110 |
| 1343443 | 825 | 840 | 14519 | 14534 | TTATTACTTTGATACT | 40 | S | 522 |
| 1343446 | 1069 | 1084 | 14763 | 14778 | ATGTACTAGAATTCTG | 58 | S | 112 |
| 1343449 | 1019 | 1034 | 14713 | 14728 | ATTATGTAAGAGTATG | 76 | S | 831 |
| 1343451 | 1016 | 1031 | 14710 | 14725 | ATGTAAGAGTATGGCC | 105 | S | 111 |
| 1343454 | 994 | 1009 | 14688 | 14703 | TTCCATACTTGATTCT | 49 | S | 464 |
| 1343455 | 1014 | 1029 | 14708 | 14723 | GTAAGAGTATGGCCTT | 78 | S | 36 |
| 1343457 | 1134 | 1149 | 14828 | 14843 | ACATATTAACCACCAG | 28 | S | 188 |
| 1343461 | 1138 | 1153 | 14832 | 14847 | TGTCACATATTAACCA | 26 | S | 713 |
| 1343464 | 1132 | 1147 | 14826 | 14841 | ATATTAACCACCAGTT | 28 | S | 38 |
| 1343465 | 1136 | 1151 | 14830 | 14845 | TCACATATTAACCACC | 43 | S | 39 |
| 1343468 | 1511 | 1526 | 15205 | 15220 | CCCACGAATTGTCAGC | 48 | S | 124 |
| 1343469 | 1509 | 1524 | 15203 | 15218 | CACGAATTGTCAGCTC | 86 | S | 274 |
| 1343472 | 1504 | 1519 | 15198 | 15213 | ATTGTCAGCTCCCCTA | 36 | S | 1496 |
| 1343474 | 1506 | 1521 | 15200 | 15215 | GAATTGTCAGCTCCCC | 40 | S | 1491 |
| 1343475 | 1247 | 1262 | 14941 | 14956 | AAGATATAGTATGGTA | 11 | S | 45 |
| 1343478 | 1558 | 1573 | 15252 | 15267 | AGGTTTATGGTCAATA | 14 | S | 278 |
| 1343480 | 1556 | 1571 | 15250 | 15265 | GTTTATGGTCAATAGT | 47 | S | 202 |
| 1343481 | 1540 | 1555 | 15234 | 15249 | AGGCTATTAGGTAGTT | 41 | S | 127 |
| 1343482 | 1524 | 1539 | 15218 | 15233 | AAGATTTTGCGGACCC | 76 | S | 913 |
| 1343484 | 1520 | 1535 | 15214 | 15229 | TTTTGCGGACCCACGA | 50 | S | 1497 |
| 1343485 | 1513 | 1528 | 15207 | 15222 | GACCCACGAATTGTCA | 87 | S | 1279 |
| 1343487 | 1562 | 1577 | 15256 | 15271 | AGTAAGGTTTATGGTC | 50 | S | 128 |
| 1343488 | N/A | N/A | 3802 | 3817 | TGTAAATAGCTCAGTT | 30 | S | 466 |

TABLE 3-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343489 | 2184 | 2199 | 15878 | 15893 | TTGGATTATGCAGTAT | 79 | S | 287 |
| 1343490 | N/A | N/A | 3617 | 3632 | ACCAGTAACCAGGATC | 73 | S | 296 |
| 1343492 | 2180 | 2195 | 15874 | 15889 | ATTATGCAGTATAGGT | 49 | S | 1013 |
| 1343495 | 1564 | 1579 | 15258 | 15273 | TCAGTAAGGTTTATGG | 11 | S | 580 |
| 1343496 | N/A | N/A | 11632 | 11647 | TTTTATACATCCCATA | 79 | S | 932 |
| 1343498 | N/A | N/A | 6410 | 6425 | GGTAGTATTGAGAAAG | 41 | S | 1498 |
| 1343499 | N/A | N/A | 6406 | 6421 | GTATTGAGAAAGTCTT | 54 | S | 748 |
| 1343501 | N/A | N/A | 3806 | 3821 | CAGATGTAAATAGCTC | 52 | S | 1275 |
| 1343505 | N/A | N/A | 4209 | 4224 | AGGCATTAATAGGCAG | 89 | S | 222 |
| 1343514 | N/A | N/A | 11636 | 11651 | GTCCTTTTATACATCC | 74 | S | 735 |
| 1121455 | 1506 | 1521 | 15200 | 15215 | GAATTGTCAGCTCCCC | 18 | T | 198 |
| 1343236 | 365 | 380 | 14059 | 14074 | AAGCATCACGATGATA | 108 | T | 106 |
| 1343238 | 81 | 96 | 3343 | 3358 | GTGTTGTATGAAGTCT | 27 | T | 818 |
| 1343240 | 556 | 571 | 14250 | 14265 | TTACAAGATCCAACAG | 41 | T | 258 |
| 1343241 | 71 | 86 | 3333 | 3348 | AAGTCTTACGGGTGTT | 22 | T | 1228 |
| 1343245 | 820 | 835 | 14514 | 14529 | ACTTTGATACTTGGTG | 61 | T | 728 |
| 1343246 | 714 | 729 | 14408 | 14423 | ATGAAGTGAACTTGTT | 67 | T | 572 |
| 1343248 | 704 | 719 | 14398 | 14413 | CTTGTTGGCAGTGCAG | 79 | T | 1055 |
| 1343251 | 401 | 416 | 14095 | 14110 | AGCTGCAGATCTAGAG | 85 | T | 1499 |
| 1343252 | 392 | 407 | 14086 | 14101 | TCTAGAGGTTGTAGCA | 45 | T | 370 |
| 1343255 | 828 | 843 | 14522 | 14537 | GTGTTATTACTTTGAT | 15 | T | 320 |
| 1343256 | 1129 | 1144 | 14823 | 14838 | TTAACCACCAGTTCTC | 68 | T | 990 |
| 1343257 | 987 | 1002 | 14681 | 14696 | CTTGATTCTCATCAAC | 66 | T | 797 |
| 1343258 | 919 | 934 | 14613 | 14628 | TAGATTCTGATAGTTA | 27 | T | 1500 |
| 1343260 | 997 | 1012 | 14691 | 14706 | CTTTTCCATACTTGAT | 31 | T | 1501 |
| 1343264 | 1139 | 1154 | 14833 | 14848 | CTGTCACATATTAACC | 24 | T | 1502 |
| 1343265 | 1515 | 1530 | 15209 | 15224 | CGGACCCACGAATTGT | 56 | T | 1092 |
| 1343266 | 1505 | 1520 | 15199 | 15214 | AATTGTCAGCTCCCCT | 40 | T | 1406 |
| 1343267 | 1501 | 1516 | 15195 | 15210 | GTCAGCTCCCCTAACC | 87 | T | 1503 |
| 1343269 | 1141 | 1156 | 14835 | 14850 | CACTGTCACATATTAA | 52 | T | 1504 |
| 1343273 | 1131 | 1146 | 14825 | 14840 | TATTAACCACCAGTTC | 34 | T | 886 |
| 1343275 | 1557 | 1572 | 15251 | 15266 | GGTTTATGGTCAATAG | 13 | T | 910 |
| 1343276 | 1567 | 1582 | 15261 | 15276 | TTATCAGTAAGGTTTA | 48 | T | 502 |
| 1343277 | 1553 | 1568 | 15247 | 15262 | TATGGTCAATAGTAGG | 16 | T | 1142 |
| 1343279 | 1527 | 1542 | 15221 | 15236 | GTTAAGATTTTGCGGA | 46 | T | 51 |

TABLE 3-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5′ to 3′) | PLN (% UTC) | AID | SEQ ID NO |
|---|---|---|---|---|---|---|---|---|
| 1343282 | 1563 | 1578 | 15257 | 15272 | CAGTAAGGTTTATGGT | 29 | T | 638 |
| 1343283 | 1517 | 1532 | 15211 | 15226 | TGCGGACCCACGAATT | 81 | T | 275 |
| 1343285 | N/A | N/A | 11639 | 11654 | TAAGTCCTTTTATACA | 91 | T | 1505 |
| 1343286 | N/A | N/A | 6413 | 6428 | GGAGGTAGTATTGAGA | 50 | T | 410 |
| 1343288 | N/A | N/A | 3809 | 3824 | GTTCAGATGTAAATAG | 55 | T | 1100 |
| 1343289 | N/A | N/A | 6403 | 6418 | TTGAGAAAGTCTTAAG | 78 | T | 885 |
| 1343291 | N/A | N/A | 3799 | 3814 | AAATAGCTCAGTTCTG | 85 | T | 560 |
| 1343399 | 261 | 276 | 13955 | 13970 | TTGAGGCTCTTCTTAT | 100 | T | 1506 |
| 1343400 | 76 | 91 | 3338 | 3353 | GTATGAAGTCTTACGG | 72 | T | 167 |
| 1343402 | 561 | 576 | 14255 | 14270 | CATGTTTACAAGATCC | 56 | T | 91 |
| 1343407 | 274 | 289 | 13968 | 13983 | GGCATTTCAATGGTTG | 45 | T | 178 |
| 1343409 | 272 | 287 | 13966 | 13981 | CATTTCAATGGTTGAG | 91 | T | 28 |
| 1343412 | 268 | 283 | 13962 | 13977 | TCAATGGTTGAGGCTC | 82 | T | 27 |
| 1343413 | 270 | 285 | 13964 | 13979 | TTTCAATGGTTGAGGC | 53 | T | 177 |
| 1343415 | 265 | 280 | 13959 | 13974 | ATGGTTGAGGCTCTTC | 44 | T | 103 |
| 1343416 | 276 | 291 | 13970 | 13985 | GAGGCATTTCAATGGT | 72 | T | 29 |
| 1343418 | 404 | 419 | 14098 | 14113 | GCAAGCTGCAGATCTA | 89 | T | 1507 |
| 1343421 | 397 | 412 | 14091 | 14106 | GCAGATCTAGAGGTTG | 37 | T | 32 |
| 1343423 | 370 | 385 | 14064 | 14079 | CAGAGAAGCATCACGA | 75 | T | 256 |
| 1343426 | 408 | 423 | 14102 | 14117 | TGTGGCAAGCTGCAGA | 84 | T | 1508 |
| 1343427 | 813 | 828 | 14507 | 14522 | TACTTGGTGAAGACCT | 67 | T | 1045 |
| 1343428 | 823 | 838 | 14517 | 14532 | ATTACTTTGATACTTG | 40 | T | 260 |
| 1343430 | 817 | 832 | 14511 | 14526 | TTGATACTTGGTGAAG | 29 | T | 895 |
| 1343434 | 709 | 724 | 14403 | 14418 | GTGAACTTGTTGGCAG | 45 | T | 259 |
| 1343436 | 992 | 1007 | 14686 | 14701 | CCATACTTGATTCTCA | 34 | T | 185 |
| 1343438 | 916 | 931 | 14610 | 14625 | ATTCTGATAGTTACTA | 32 | T | 505 |
| 1343444 | 914 | 929 | 14608 | 14623 | TCTGATAGTTACTACA | 29 | T | 35 |
| 1343445 | 912 | 927 | 14606 | 14621 | TGATAGTTACTACAAA | 70 | T | 655 |
| 1343447 | 1012 | 1027 | 14706 | 14721 | AAGAGTATGGCCTTAC | 91 | T | 993 |
| 1343448 | 1067 | 1082 | 14761 | 14776 | GTACTAGAATTCTGTG | 51 | T | 37 |
| 1343452 | 1017 | 1032 | 14711 | 14726 | TATGTAAGAGTATGGC | 24 | T | 186 |
| 1343453 | 1015 | 1030 | 14709 | 14724 | TGTAAGAGTATGGCCT | 86 | T | 920 |
| 1343456 | 1071 | 1086 | 14765 | 14780 | ACATGTACTAGAATTC | 118 | T | 1509 |
| 1343458 | 1245 | 1260 | 14939 | 14954 | GATATAGTATGGTAAG | 37 | T | 1046 |
| 1343460 | 1137 | 1152 | 14831 | 14846 | GTCACATATTAACCAC | 56 | T | 802 |
| 1343462 | 1135 | 1150 | 14829 | 14844 | CACATATTAACCACCA | 31 | T | 264 |

TABLE 3-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343463 | 1133 | 1148 | 14827 | 14842 | CATATTAACCACCAGT | 53 | T | 113 |
| 1343467 | 1249 | 1264 | 14943 | 14958 | CAAAGATATAGTATGG | 16 | T | 942 |
| 1343470 | 1512 | 1527 | 15206 | 15221 | ACCCACGAATTGTCAG | 141 | T | 199 |
| 1343471 | 1510 | 1525 | 15204 | 15219 | CCACGAATTGTCAGCT | 43 | T | 49 |
| 1343473 | 1508 | 1523 | 15202 | 15217 | ACGAATTGTCAGCTCC | 70 | T | 1374 |
| 1343477 | 1522 | 1537 | 15216 | 15231 | GATTTTGCGGACCCAC | 41 | T | 125 |
| 1343479 | 1542 | 1557 | 15236 | 15251 | GTAGGCTATTAGGTAG | 37 | T | 1367 |
| 1343483 | 1538 | 1553 | 15232 | 15247 | GCTATTAGGTAGTTAA | 43 | T | 277 |
| 1343486 | N/A | N/A | 3619 | 3634 | AAACCAGTAACCAGGA | 46 | T | 1263 |
| 1343491 | N/A | N/A | 3615 | 3630 | CAGTAACCAGGATCAA | 60 | T | 444 |
| 1343493 | 1560 | 1575 | 15254 | 15269 | TAAGGTTTATGGTCAA | 24 | T | 704 |
| 1343494 | 2182 | 2197 | 15876 | 15891 | GGATTATGCAGTATAG | 49 | T | 211 |
| 1343497 | N/A | N/A | 3804 | 3819 | GATGTAAATAGCTCAG | 33 | T | 71 |
| 1343500 | N/A | N/A | 6408 | 6423 | TAGTATTGAGAAAGTC | 68 | T | 301 |
| 1343502 | N/A | N/A | 4211 | 4226 | ATAGGCATTAATAGGC | 36 | T | 1117 |
| 1343503 | N/A | N/A | 4207 | 4222 | GCATTAATAGGCAGAA | 50 | T | 1388 |
| 1343508 | N/A | N/A | 11634 | 11649 | CCTTTTATACATCCCA | 76 | T | 85 |
| 1343141 | 822 | 837 | 14516 | 14531 | TTACTTTGATACTTGG | 7 | Y | 612 |
| 1393478 | N/A | N/A | 3807 | 3822 | TCAGATGTAAATAGCT | 62 | Y | 1225 |
| 1393479 | N/A | N/A | 7359 | 7374 | GATGTTGTATATGCTG | 42 | Y | 1187 |
| 1393480 | N/A | N/A | 3805 | 3820 | AGATGTAAATAGCTCA | 43 | Y | 1355 |
| 1393481 | N/A | N/A | 7360 | 7375 | TGATGTTGTATATGCT | 30 | Y | 1510 |
| 1393482 | N/A | N/A | 5497 | 5512 | GAGTATATTAGGAAAT | 56 | Y | 1399 |
| 1393483 | N/A | N/A | 7358 | 7373 | ATGTTGTATATGCTGA | 39 | Y | 1455 |
| 1393484 | 1611 | 1626 | 15305 | 15320 | TAATACATATAACACG | 88 | Y | 1398 |
| 1393485 | 1609 | 1624 | 15303 | 15318 | ATACATATAACACGCA | 38 | Y | 1397 |
| 1393486 | N/A | N/A | 5498 | 5513 | CGAGTATATTAGGAAA | 12 | Y | 1396 |
| 1393487 | N/A | N/A | 5501 | 5516 | ACACGAGTATATTAGG | 31 | Y | 609 |
| 1393488 | 1607 | 1622 | 15301 | 15316 | ACATATAACACGCAAA | 30 | Y | 54 |
| 1393489 | N/A | N/A | 5502 | 5517 | TACACGAGTATATTAG | 46 | Y | 538 |
| 1393490 | N/A | N/A | 5500 | 5515 | CACGAGTATATTAGGA | 19 | Y | 675 |
| 1393491 | 1610 | 1625 | 15304 | 15319 | AATACATATAACACGC | 41 | Y | 426 |
| 1393492 | 1608 | 1623 | 15302 | 15317 | TACATATAACACGCAA | 22 | Y | 129 |
| 1393493 | N/A | N/A | 5499 | 5514 | ACGAGTATATTAGGAA | 8 | Y | 737 |
| 1393494 | N/A | N/A | 4234 | 4249 | GAGGATAATAACTTGA | 61 | Y | 665 |

TABLE 3-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393495 | N/A | N/A | 4233 | 4248 | AGGATAATAACTTGAC | 30 | Y | 740 |
| 1393496 | N/A | N/A | 4235 | 4250 | GGAGGATAATAACTTG | 58 | Y | 1478 |
| 1393498 | N/A | N/A | 4236 | 4251 | TGGAGGATAATAACTT | 65 | Y | 1477 |
| 1393499 | N/A | N/A | 4232 | 4247 | GGATAATAACTTGACA | 31 | Y | 809 |
| 1393500 | N/A | N/A | 5415 | 5430 | TCTAATTTGGAGAGGT | 74 | Y | 1149 |
| 1393501 | N/A | N/A | 5413 | 5428 | TAATTTGGAGAGGTAA | 49 | Y | 1479 |
| 1393502 | N/A | N/A | 4231 | 4246 | GATAATAACTTGACAA | 72 | Y | 1480 |
| 1393503 | N/A | N/A | 5414 | 5429 | CTAATTTGGAGAGGTA | 19 | Y | 1202 |
| 1393504 | N/A | N/A | 5417 | 5432 | TGTCTAATTTGGAGAG | 78 | Y | 1482 |
| 1393505 | 647 | 662 | 14341 | 14356 | AGAAATTTGTGAGCCA | 33 | Y | 1485 |
| 1393506 | N/A | N/A | 5419 | 5434 | ATTGTCTAATTTGGAG | 49 | Y | 1483 |
| 1393507 | N/A | N/A | 5418 | 5433 | TTGTCTAATTTGGAGA | 66 | Y | 1481 |
| 1393508 | 648 | 663 | 14342 | 14357 | TAGAAATTTGTGAGCC | 36 | Y | 1360 |
| 1393509 | 646 | 661 | 14340 | 14355 | GAAATTTGTGAGCCAT | 31 | Y | 1486 |
| 1393510 | N/A | N/A | 5416 | 5431 | GTCTAATTTGGAGAGG | 96 | Y | 1051 |
| 1393511 | 649 | 664 | 14343 | 14358 | ATAGAAATTTGTGAGC | 47 | Y | 1253 |
| 1393512 | 645 | 660 | 14339 | 14354 | AAATTTGTGAGCCATG | 35 | Y | 1488 |
| 1393513 | 650 | 665 | 14344 | 14359 | GATAGAAATTTGTGAG | 70 | Y | 1487 |
| 1393514 | N/A | N/A | 4541 | 4556 | TTATTTGTAGTGAGCA | 19 | Y | 1489 |
| 1393515 | N/A | N/A | 4540 | 4555 | TATTTGTAGTGAGCAA | 25 | Y | 1484 |
| 1393516 | N/A | N/A | 4539 | 4554 | ATTTGTAGTGAGCAAT | 62 | Y | 1490 |
| 1393517 | 1311 | 1326 | 15005 | 15020 | TGTTAGGCTGGAATGG | 35 | Y | 46 |
| 1393518 | N/A | N/A | 4543 | 4558 | TCTTATTTGTAGTGAG | 59 | Y | 480 |
| 1393519 | 651 | 666 | 14345 | 14360 | GGATAGAAATTTGTGA | 30 | Y | 1207 |
| 1393520 | 1312 | 1327 | 15006 | 15021 | ATGTTAGGCTGGAATG | 30 | Y | 630 |
| 1393521 | N/A | N/A | 4545 | 4560 | GTTCTTATTTGTAGTG | 59 | Y | 1401 |
| 1393522 | N/A | N/A | 4542 | 4557 | CTTATTTGTAGTGAGC | 38 | Y | 598 |
| 1393523 | N/A | N/A | 4544 | 4559 | TTCTTATTTGTAGTGA | 56 | Y | 1400 |
| 1393524 | 1313 | 1328 | 15007 | 15022 | GATGTTAGGCTGGAAT | 22 | Y | 587 |
| 1393525 | 1314 | 1329 | 15008 | 15023 | GGATGTTAGGCTGGAA | 16 | Y | 519 |
| 1393526 | N/A | N/A | 7862 | 7877 | GTGTAGAAATGCCAGA | 67 | Y | 1294 |
| 1393527 | 1316 | 1331 | 15010 | 15025 | TTGGATGTTAGGCTGG | 50 | Y | 1410 |
| 1393528 | N/A | N/A | 7863 | 7878 | GGTGTAGAAATGCCAG | 70 | Y | 1408 |
| 1393529 | N/A | N/A | 7860 | 7875 | GTAGAAATGCCAGACT | 43 | Y | 1335 |
| 1393530 | N/A | N/A | 7859 | 7874 | TAGAAATGCCAGACTC | 69 | Y | 359 |
| 1393532 | N/A | N/A | 7861 | 7876 | TGTAGAAATGCCAGAC | 61 | Y | 1404 |

TABLE 3-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5′ to 3′) | PLN (% UTC) | AID | SEQ ID NO |
|---|---|---|---|---|---|---|---|---|
| 1393533 | 1315 | 1330 | 15009 | 15024 | TGGATGTTAGGCTGGA | 122 | Y | 1511 |
| 1393534 | 1529 | 1544 | 15223 | 15238 | TAGTTAAGATTTTGCG | 36 | Y | 819 |
| 1393535 | 875 | 890 | 14569 | 14584 | CAGATGTGAGGAGTCA | 27 | Y | 1411 |
| 1393536 | 879 | 894 | 14573 | 14588 | ATAACAGATGTGAGGA | 56 | Y | 1072 |
| 1393537 | 876 | 891 | 14570 | 14585 | ACAGATGTGAGGAGTC | 22 | Y | 1407 |
| 1393538 | 1528 | 1543 | 15222 | 15237 | AGTTAAGATTTTGCGG | 25 | Y | 1403 |
| 1393539 | N/A | N/A | 7865 | 7880 | TGGGTGTAGAAATGCC | 47 | Y | 1402 |
| 1393540 | 877 | 892 | 14571 | 14586 | AACAGATGTGAGGAGT | 26 | Y | 1136 |
| 1393541 | 1530 | 1545 | 15224 | 15239 | GTAGTTAAGATTTTGC | 20 | Y | 752 |
| 1393542 | 1507 | 1522 | 15201 | 15216 | CGAATTGTCAGCTCCC | 50 | Y | 339 |
| 1393543 | N/A | N/A | 7864 | 7879 | GGGTGTAGAAATGCCA | 92 | Y | 1409 |
| 1393544 | 86 | 101 | 3348 | 3363 | GTATTGTGTTGTATGA | 41 | Y | 1512 |
| 1393545 | 1533 | 1548 | 15227 | 15242 | TAGGTAGTTAAGATTT | 50 | Y | 613 |
| 1393546 | 1531 | 1546 | 15225 | 15240 | GGTAGTTAAGATTTTG | 35 | Y | 689 |
| 1393547 | N/A | N/A | 4517 | 4532 | AACATTTGTCATAGGA | 28 | Y | 1415 |
| 1393548 | N/A | N/A | 4515 | 4530 | CATTTGTCATAGGAAT | 29 | Y | 1405 |
| 1393550 | N/A | N/A | 5503 | 5518 | GTACACGAGTATATTA | 75 | Y | 1421 |
| 1393551 | N/A | N/A | 4516 | 4531 | ACATTTGTCATAGGAA | 22 | Y | 1420 |
| 1393552 | N/A | N/A | 4519 | 4534 | TTAACATTTGTCATAG | 38 | Y | 708 |
| 1393553 | N/A | N/A | 4518 | 4533 | TAACATTTGTCATAGG | 25 | Y | 828 |
| 1393555 | 87 | 102 | 3349 | 3364 | AGTATTGTGTTGTATG | 25 | Y | 1513 |
| 1393557 | 90 | 105 | 3352 | 3367 | TAGAGTATTGTGTTGT | 37 | Y | 1419 |
| 1393559 | 88 | 103 | 3350 | 3365 | GAGTATTGTGTTGTAT | 24 | Y | 756 |
| 1393562 | 89 | 104 | 3351 | 3366 | AGAGTATTGTGTTGTA | 15 | Y | 1416 |
| 1343141 | 822 | 837 | 14516 | 14531 | TTACTTTGATACTTGG | 6 | Z | 612 |
| 1393394 | 557 | 572 | 14251 | 14266 | TTTACAAGATCCAACA | 52 | Z | 1395 |
| 1393395 | 1317 | 1332 | 15011 | 15026 | ATTGGATGTTAGGCTG | 53 | Z | 1514 |
| 1393396 | 558 | 573 | 14252 | 14267 | GTTTACAAGATCCAAC | 25 | Z | 33 |
| 1393397 | 1318 | 1333 | 15012 | 15027 | CATTGGATGTTAGGCT | 33 | Z | 1450 |
| 1393399 | 1319 | 1334 | 15013 | 15028 | GCATTGGATGTTAGGC | 24 | Z | 121 |
| 1393400 | 560 | 575 | 14254 | 14269 | ATGTTTACAAGATCCA | 19 | Z | 700 |
| 1393401 | 562 | 577 | 14256 | 14271 | TCATGTTTACAAGATC | 43 | Z | 1515 |
| 1393404 | 1321 | 1336 | 15015 | 15030 | CTGCATTGGATGTTAG | 24 | Z | 196 |
| 1393405 | N/A | N/A | 11990 | 12005 | GTAGTAGTTTCCATCA | 42 | Z | 1417 |
| 1393406 | N/A | N/A | 11991 | 12006 | AGTAGTAGTTTCCATC | 38 | Z | 1422 |

TABLE 3-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393408 | 1559 | 1574 | 15253 | 15268 | AAGGTTTATGGTCAAT | 28 | Z | 784 |
| 1393409 | 1322 | 1337 | 15016 | 15031 | CCTGCATTGGATGTTA | 60 | Z | 1516 |
| 1393410 | 1323 | 1338 | 15017 | 15032 | GCCTGCATTGGATGTT | 37 | Z | 1517 |
| 1393411 | 1561 | 1576 | 15255 | 15270 | GTAAGGTTTATGGTCA | 29 | Z | 53 |
| 1393412 | N/A | N/A | 11992 | 12007 | TAGTAGTAGTTTCCAT | 59 | Z | 1345 |
| 1393413 | 1320 | 1335 | 15014 | 15029 | TGCATTGGATGTTAGG | 27 | Z | 392 |
| 1393414 | 1264 | 1279 | 14958 | 14973 | AAGGTTTCATGATTCC | 22 | Z | 632 |
| 1393415 | 1267 | 1282 | 14961 | 14976 | CTTAAGGTTTCATGAT | 60 | Z | 195 |
| 1393416 | N/A | N/A | 11995 | 12010 | TAATAGTAGTAGTTTC | 84 | Z | 1425 |
| 1393417 | 1263 | 1278 | 14957 | 14972 | AGGTTTCATGATTCCA | 43 | Z | 1427 |
| 1393418 | N/A | N/A | 11994 | 12009 | AATAGTAGTAGTTTCC | 79 | Z | 1166 |
| 1393419 | 1265 | 1280 | 14959 | 14974 | TAAGGTTTCATGATTC | 30 | Z | 615 |
| 1393420 | N/A | N/A | 11993 | 12008 | ATAGTAGTAGTTTCCA | 53 | Z | 1243 |
| 1393421 | 1262 | 1277 | 14956 | 14971 | GGTTTCATGATTCCAA | 31 | Z | 1426 |
| 1393422 | 1266 | 1281 | 14960 | 14975 | TTAAGGTTTCATGATT | 58 | Z | 1428 |
| 1393423 | 622 | 637 | 14316 | 14331 | AATCAACAGTTGCATT | 40 | Z | 1518 |
| 1393424 | 627 | 642 | 14321 | 14336 | GAGGAAATCAACAGTT | 39 | Z | 1430 |
| 1393425 | 625 | 640 | 14319 | 14334 | GGAAATCAACAGTTGC | 33 | Z | 564 |
| 1393426 | 624 | 639 | 14318 | 14333 | GAAATCAACAGTTGCA | 44 | Z | 644 |
| 1393427 | N/A | N/A | 7287 | 7302 | CTTCAGTATTTTTGGT | 41 | Z | 1435 |
| 1393428 | N/A | N/A | 7286 | 7301 | TTCAGTATTTTTGGTG | 80 | Z | 1433 |
| 1393429 | N/A | N/A | 7284 | 7299 | CAGTATTTTTGGTGGT | 63 | Z | 642 |
| 1393430 | 623 | 638 | 14317 | 14332 | AAATCAACAGTTGCAT | 35 | Z | 1429 |
| 1393431 | N/A | N/A | 7282 | 7297 | GTATTTTTGGTGGTAT | 35 | Z | 1431 |
| 1393432 | N/A | N/A | 7285 | 7300 | TCAGTATTTTTGGTGG | 89 | Z | 1434 |
| 1393433 | N/A | N/A | 7283 | 7298 | AGTATTTTTGGTGGTA | 51 | Z | 1432 |
| 1393434 | N/A | N/A | 12090 | 12105 | TTTGATGTTAAGTACT | 82 | Z | 1439 |
| 1393435 | N/A | N/A | 12085 | 12100 | TGTTAAGTACTGAAGA | 47 | Z | 1436 |
| 1393436 | 538 | 553 | 14232 | 14247 | GAATACATATGGTAAC | 38 | Z | 1386 |
| 1393437 | N/A | N/A | 12086 | 12101 | ATGTTAAGTACTGAAG | 48 | Z | 1437 |
| 1393438 | N/A | N/A | 12084 | 12099 | GTTAAGTACTGAAGAC | 77 | Z | 1125 |
| 1393439 | 539 | 554 | 14233 | 14248 | TGAATACATATGGTAA | 48 | Z | 1440 |
| 1393441 | N/A | N/A | 12087 | 12102 | GATGTTAAGTACTGAA | 39 | Z | 1031 |
| 1393442 | N/A | N/A | 12088 | 12103 | TGATGTTAAGTACTGA | 51 | Z | 1438 |
| 1393443 | N/A | N/A | 12089 | 12104 | TTGATGTTAAGTACTG | 73 | Z | 1519 |
| 1393445 | N/A | N/A | 7563 | 7578 | ACTAATGTCATATACC | 88 | Z | 1344 |

TABLE 3-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393446 | N/A | N/A | 7561 | 7576 | TAATGTCATATACCAT | 70 | Z | 1442 |
| 1393447 | N/A | N/A | 7564 | 7579 | GACTAATGTCATATAC | 90 | Z | 1244 |
| 1393448 | N/A | N/A | 7562 | 7577 | CTAATGTCATATACCA | 49 | Z | 353 |
| 1393449 | 1565 | 1580 | 15259 | 15274 | ATCAGTAAGGTTTATG | 58 | Z | 203 |
| 1393450 | N/A | N/A | 7560 | 7575 | AATGTCATATACCATG | 38 | Z | 1441 |
| 1393451 | N/A | N/A | 7566 | 7581 | TTGACTAATGTCATAT | 110 | Z | 1444 |
| 1393452 | N/A | N/A | 7565 | 7580 | TGACTAATGTCATATA | 59 | Z | 1443 |
| 1393453 | 541 | 556 | 14235 | 14250 | GATGAATACATATGGT | 16 | Z | 1262 |
| 1393454 | 1271 | 1286 | 14965 | 14980 | AAGTCTTAAGGTTTCA | 41 | Z | 1446 |
| 1393455 | 1268 | 1283 | 14962 | 14977 | TCTTAAGGTTTCATGA | 64 | Z | 533 |
| 1393456 | 1269 | 1284 | 14963 | 14978 | GTCTTAAGGTTTCATG | 22 | Z | 454 |
| 1393457 | N/A | N/A | 5848 | 5863 | ATGTAATGCTATGCAT | 91 | Z | 1448 |
| 1393458 | 1270 | 1285 | 14964 | 14979 | AGTCTTAAGGTTTCAT | 32 | Z | 338 |
| 1393459 | N/A | N/A | 5851 | 5866 | AGAATGTAATGCTATG | 49 | Z | 1449 |
| 1393460 | N/A | N/A | 5847 | 5862 | TGTAATGCTATGCATA | 81 | Z | 1447 |
| 1393461 | N/A | N/A | 5850 | 5865 | GAATGTAATGCTATGC | 39 | Z | 732 |
| 1393462 | 1272 | 1287 | 14966 | 14981 | GAAGTCTTAAGGTTTC | 36 | Z | 1391 |
| 1393463 | 1566 | 1581 | 15260 | 15275 | TATCAGTAAGGTTTAT | 54 | Z | 1445 |
| 1393464 | N/A | N/A | 6943 | 6958 | CTTTTTTGGACTTGTG | 12 | Z | 77 |
| 1393465 | N/A | N/A | 6945 | 6960 | CCCTTTTTTGGACTTG | 39 | Z | 1453 |
| 1393466 | N/A | N/A | 6939 | 6954 | TTTGGACTTGTGGTAA | 49 | Z | 1520 |
| 1393467 | N/A | N/A | 6941 | 6956 | TTTTTGGACTTGTGGT | 29 | Z | 1451 |
| 1393468 | N/A | N/A | 7357 | 7372 | TGTTGTATATGCTGAG | 59 | Z | 1521 |
| 1393469 | N/A | N/A | 6942 | 6957 | TTTTTTGGACTTGTGG | 30 | Z | 585 |
| 1393471 | N/A | N/A | 7356 | 7371 | GTTGTATATGCTGAGC | 31 | Z | 1454 |
| 1393472 | N/A | N/A | 6940 | 6955 | TTTTGGACTTGTGGTA | 25 | Z | 1522 |
| 1393473 | N/A | N/A | 6944 | 6959 | CCTTTTTTGGACTTGT | 35 | Z | 1452 |
| 1393474 | N/A | N/A | 3803 | 3818 | ATGTAAATAGCTCAGT | 37 | Z | 378 |
| 1393475 | N/A | N/A | 3808 | 3823 | TTCAGATGTAAATAGC | 53 | Z | 1394 |
| 1393476 | N/A | N/A | 7362 | 7377 | AATGATGTTGTATATG | 60 | Z | 1393 |
| 1393477 | N/A | N/A | 7361 | 7376 | ATGATGTTGTATATGC | 33 | Z | 1523 |
| 1393554 | 526 | 541 | 14220 | 14235 | TAACAATAAGTTTTAG | 77 | AA | 1412 |
| 1393558 | 530 | 545 | 14224 | 14239 | ATGGTAACAATAAGTT | 39 | AA | 1418 |
| 1393560 | 528 | 543 | 14222 | 14237 | GGTAACAATAAGTTTT | 56 | AA | 450 |
| 1393561 | 529 | 544 | 14223 | 14238 | TGGTAACAATAAGTTT | 63 | AA | 358 |

TABLE 3-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393563 | 91 | 106 | 3353 | 3368 | ATAGAGTATTGTGTTG | 31 | AA | 636 |
| 1393564 | 531 | 546 | 14225 | 14240 | TATGGTAACAATAAGT | 62 | AA | 1414 |
| 1393565 | 1466 | 1481 | 15160 | 15175 | TGTAGATGTAATAGAT | 60 | AA | 924 |
| 1393566 | 1467 | 1482 | 15161 | 15176 | CTGTAGATGTAATAGA | 61 | AA | 48 |
| 1393567 | 1465 | 1480 | 15159 | 15174 | GTAGATGTAATAGATG | 34 | AA | 972 |
| 1393568 | 819 | 834 | 14513 | 14528 | CTTTGATACTTGGTGA | 16 | AA | 184 |
| 1393569 | N/A | N/A | 5504 | 5519 | TGTACACGAGTATATT | 76 | AA | 1413 |
| 1393570 | 1463 | 1478 | 15157 | 15172 | AGATGTAATAGATGGG | 65 | AA | 1106 |
| 1393571 | 1464 | 1479 | 15158 | 15173 | TAGATGTAATAGATGG | 29 | AA | 1077 |
| 1393572 | 1462 | 1477 | 15156 | 15171 | GATGTAATAGATGGGC | 83 | AA | 1181 |
| 1393573 | 1461 | 1476 | 15155 | 15170 | ATGTAATAGATGGGCC | 91 | AA | 273 |
| 1393574 | 822 | 837 | 14516 | 14531 | TTACTTTGATACTTGG | 20 | AA | 612 |
| 1393575 | 1246 | 1261 | 14940 | 14955 | AGATATAGTATGGTAA | 12 | AA | 270 |
| 1393577 | 1250 | 1265 | 14944 | 14959 | CCAAAGATATAGTATG | 44 | AA | 921 |
| 1393578 | 1544 | 1559 | 15238 | 15253 | TAGTAGGCTATTAGGT | 23 | AA | 1313 |
| 1393579 | 1543 | 1558 | 15237 | 15252 | AGTAGGCTATTAGGTA | 31 | AA | 1424 |
| 1393581 | 1248 | 1263 | 14942 | 14957 | AAAGATATAGTATGGT | 18 | AA | 120 |
| 1393583 | 1018 | 1033 | 14712 | 14727 | TTATGTAAGAGTATGG | 46 | AA | 262 |
| 1393588 | 1244 | 1259 | 14938 | 14953 | ATATAGTATGGTAAGC | 33 | AA | 194 |
| 1393591 | 1251 | 1266 | 14945 | 14960 | TCCAAAGATATAGTAT | 46 | AA | 1423 |
| 1393592 | 1243 | 1258 | 14937 | 14952 | TATAGTATGGTAAGCT | 54 | AA | 119 |
| 1393958 | 1554 | 1569 | 15248 | 15263 | TTATGGTCAATAGTAG | 17 | AA | 1015 |
| 1393959 | N/A | N/A | 7279 | 7294 | TTTTTGGTGGTATTCC | 53 | AA | 1457 |
| 1393960 | N/A | N/A | 11998 | 12013 | ACTTAATAGTAGTAGT | 87 | AA | 1456 |
| 1393961 | N/A | N/A | 11988 | 12003 | AGTAGTTTCCATCATG | 79 | AA | 1524 |
| 1393962 | 555 | 570 | 14249 | 14264 | TACAAGATCCAACAGA | 70 | AA | 888 |
| 1393963 | 630 | 645 | 14324 | 14339 | GTTGAGGAAATCAACA | 75 | AA | 514 |
| 1393965 | 1325 | 1340 | 15019 | 15034 | TTGCCTGCATTGGATG | 35 | AA | 1525 |
| 1393966 | N/A | N/A | 12082 | 12097 | TAAGTACTGAAGACTG | 82 | AA | 1198 |
| 1393967 | 1555 | 1570 | 15249 | 15264 | TTTATGGTCAATAGTA | 67 | AA | 934 |
| 1393968 | N/A | N/A | 7354 | 7369 | TGTATATGCTGAGCAT | 59 | AA | 1291 |
| 1393969 | 1275 | 1290 | 14969 | 14984 | TCTGAAGTCTTAAGGT | 20 | AA | 271 |
| 1393970 | N/A | N/A | 6947 | 6962 | TACCCTTTTTTGGACT | 56 | AA | 1463 |
| 1393971 | N/A | N/A | 7558 | 7573 | TGTCATATACCATGTT | 45 | AA | 1459 |
| 1393972 | N/A | N/A | 5845 | 5860 | TAATGCTATGCATAAA | 85 | AA | 1461 |
| 1393973 | N/A | N/A | 7568 | 7583 | TTTTGACTAATGTCAT | 86 | AA | 1460 |

TABLE 3-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5′ to 3′) | PLN (% UTC) | AID | SEQ ID NO |
|---|---|---|---|---|---|---|---|---|
| 1393974 | N/A | N/A | 6937 | 6952 | TGGACTTGTGGTAATA | 51 | AA | 1526 |
| 1393975 | N/A | N/A | 12092 | 12107 | GATTTGATGTTAAGTA | 53 | AA | 1458 |
| 1393976 | N/A | N/A | 5855 | 5870 | ATTAAGAATGTAATGC | 98 | AA | 1462 |
| 1393977 | N/A | N/A | 3801 | 3816 | GTAAATAGCTCAGTTC | 53 | AA | 540 |
| 1393978 | 653 | 668 | 14347 | 14362 | TGGGATAGAAATTTGT | 38 | AA | 183 |
| 1393979 | N/A | N/A | 5494 | 5509 | TATATTAGGAAATTGC | 64 | AA | 1468 |
| 1393980 | N/A | N/A | 3811 | 3826 | TAGTTCAGATGTAAAT | 47 | AA | 1465 |
| 1393981 | N/A | N/A | 4537 | 4552 | TTGTAGTGAGCAATAG | 43 | AA | 1476 |
| 1393982 | N/A | N/A | 5411 | 5426 | ATTTGGAGAGGTAACT | 78 | AA | 1464 |
| 1393983 | 643 | 658 | 14337 | 14352 | ATTTGTGAGCCATGTT | 18 | AA | 1469 |
| 1393984 | 1605 | 1620 | 15299 | 15314 | ATATAACACGCAAAAT | 55 | AA | 1466 |
| 1393985 | N/A | N/A | 4238 | 4253 | ACTGGAGGATAATAAC | 95 | AA | 1470 |
| 1393986 | N/A | N/A | 5421 | 5436 | ATATTGTCTAATTTGG | 40 | AA | 1467 |
| 1393987 | 1309 | 1324 | 15003 | 15018 | TTAGGCTGGAATGGAA | 46 | AA | 1475 |
| 1393988 | 1503 | 1518 | 15197 | 15212 | TTGTCAGCTCCCCTAA | 14 | AA | 1527 |
| 1393990 | 93 | 108 | 3355 | 3370 | GTATAGAGTATTGTGT | 60 | AA | 244 |
| 1393991 | N/A | N/A | 7857 | 7872 | GAAATGCCAGACTCCT | 81 | AA | 1473 |
| 1393992 | N/A | N/A | 5505 | 5520 | GTGTACACGAGTATAT | 70 | AA | 1471 |
| 1393993 | N/A | N/A | 5495 | 5510 | GTATATTAGGAAATTG | 68 | AA | 1472 |
| 1393994 | 1525 | 1540 | 15219 | 15234 | TAAGATTTTGCGGACC | 49 | AA | 200 |
| 1393995 | N/A | N/A | 7867 | 7882 | TTTGGGTGTAGAAATG | 72 | AA | 1528 |
| 1393996 | N/A | N/A | 4513 | 4528 | TTTGTCATAGGAATTG | 39 | AA | 1529 |
| 1393997 | 83 | 98 | 3345 | 3360 | TTGTGTTGTATGAAGT | 17 | AA | 1530 |
| 1393998 | 1254 | 1269 | 14948 | 14963 | GATTCCAAAGATATAG | 39 | AA | 701 |
| 1394000 | 1469 | 1484 | 15163 | 15178 | AGCTGTAGATGTAATA | 46 | AA | 836 |
| 1394001 | 1459 | 1474 | 15153 | 15168 | GTAATAGATGGGCCAA | 86 | AA | 122 |
| 1394002 | N/A | N/A | 5506 | 5521 | TGTGTACACGAGTATA | 30 | AA | 1531 |
| 1394003 | 523 | 538 | 14217 | 14232 | CAATAAGTTTTAGTCT | 63 | AA | 1474 |
| 1394004 | 1240 | 1255 | 14934 | 14949 | AGTATGGTAAGCTAGG | 53 | AA | 1175 |
| 1394006 | 1274 | 1289 | 14968 | 14983 | CTGAAGTCTTAAGGTT | 36 | AA | 1264 |

Example 4: Effect of Mixed MOE and cEt, Uniform Phosphorothioate Modified Oligonucleotides on Human PLN RNA In Vitro, Single Dose Modified oligonucleotides complementary to human PLN nucleic acid were designed and tested for their single dose effects on PLN RNA in vitro. The modified oligonucleotides were tested in a series of experiments that had the same culture conditions.

The modified oligonucleotides in the table below are 16 nucleosides in length, wherein the sugar motif for the modified oligonucleotides is (from 5' to 3'): kkkddddddddddkkke; wherein each "d" represents a 2'-β-D- deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

"Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the table below is 100% complementary to SEQ ID NO: 1 (described herein above), to SEQ ID NO: 2 (described herein above), or to both. "N/A" indicates that the modified oligonucleotide is not 100% complementary to that particular target nucleic acid sequence.

Cultured iCell® cardiomyocytes[2] (FujiFilm Cellular Dynamics, Inc.; Catalog No: R1017) were treated with modified oligonucleotide at a concentration of 6000 nM by free uptake at a density of 8,000 cells per well. After a treatment period of approximately 72 hours, total RNA was isolated from the cells and PLN RNA levels were measured by quantitative real-time RTPCR. PLN RNA levels were measured by human primer-probe set RTS40402 (described herein above). PLN RNA levels were normalized to total RNA content, as measured by RIBOGREEN® Reduction of PLN RNA is presented in the table below as percent PLN RNA relative to the amount in untreated control cells (% UTC).

Each separate experimental analysis described in this example is identified by a letter ID in the table column below labeled "AID" (Analysis ID). In the table below, Compound Nos. 1121455 and 1343141 (described herein above) were used as benchmarks.

TABLE 4

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121455 | 1506 | 1521 | 15200 | 15215 | GAATTGTCAGCTCCCC | 18 | U | 198 |
| 1343249 | 266 | 281 | 13960 | 13975 | AATGGTTGAGGCTCTT | 45 | U | 176 |
| 1343253 | 275 | 290 | 13969 | 13984 | AGGCATTTCAATGGTT | 49 | U | 254 |
| 1343280 | 279 | 294 | 13973 | 13988 | GTTGAGGCATTTCAAT | 130 | U | 1324 |
| 1343315 | 402 | 417 | 14096 | 14111 | AAGCTGCAGATCTAGA | 88 | U | 1491 |
| 1343328 | 411 | 426 | 14105 | 14120 | TGATGTGGCAAGCTGC | 54 | U | 1493 |
| 1343357 | 920 | 935 | 14614 | 14629 | GTAGATTCTGATAGTT | 14 | U | 1319 |
| 1343359 | 909 | 924 | 14603 | 14618 | TAGTTACTACAAATAG | 82 | U | 795 |
| 1343361 | 818 | 833 | 14512 | 14527 | TTTGATACTTGGTGAA | 36 | U | 794 |
| 1343363 | 810 | 825 | 14504 | 14519 | TTGGTGAAGACCTGAA | 77 | U | 1492 |
| 1343364 | 1074 | 1089 | 14768 | 14783 | CCTACATGTACTAGAA | 80 | U | 1272 |
| 1343366 | 1242 | 1257 | 14936 | 14951 | ATAGTATGGTAAGCTA | 91 | U | 44 |
| 1343369 | 1140 | 1155 | 14834 | 14849 | ACTGTCACATATTAAC | 47 | U | 1494 |
| 1343371 | 1130 | 1145 | 14824 | 14839 | ATTAACCACCAGTTCT | 46 | U | 263 |
| 1343372 | 1009 | 1024 | 14703 | 14718 | AGTATGGCCTTACTTT | 97 | U | 1190 |
| 1343374 | 1545 | 1560 | 15239 | 15254 | ATAGTAGGCTATTAGG | 57 | U | 1223 |
| 1343375 | 1535 | 1550 | 15229 | 15244 | ATTAGGTAGTTAAGAT | 59 | U | 126 |
| 1343376 | 1252 | 1267 | 14946 | 14961 | TTCCAAAGATATAGTA | 41 | U | 812 |
| 1343380 | 258 | 273 | 13952 | 13967 | AGGCTCTTCTTATAGC | 88 | U | 250 |
| 1343381 | 1516 | 1531 | 15210 | 15225 | GCGGACCCACGAATTG | 80 | U | 1083 |
| 1343385 | N/A | N/A | 4214 | 4229 | ACTATAGGCATTAATA | 53 | U | 938 |
| 1343387 | N/A | N/A | 4204 | 4219 | TTAATAGGCAGAAATC | 72 | U | 377 |
| 1343388 | N/A | N/A | 3622 | 3637 | GACAAACCAGTAACCA | 67 | U | 1099 |
| 1343389 | N/A | N/A | 3612 | 3627 | TAACCAGGATCAAAGA | 76 | U | 562 |

TABLE 4-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5′ to 3′) | PLN (% UTC) | AID | SEQ ID NO |
|---|---|---|---|---|---|---|---|---|
| 1343396 | 559 | 574 | 14253 | 14268 | TGTTTACAAGATCCAA | 24 | U | 799 |
| 1343405 | N/A | N/A | 11636 | 11651 | GTCCTTTTATACATCC | 47 | U | 735 |
| 1343432 | 26 | 284 | 13963 | 13978 | TTCAATGGTTGAGGCT | 54 | U | 104 |
| 1343441 | 271 | 286 | 13965 | 13980 | ATTTCAATGGTTGAGG | 47 | U | 253 |
| 1343450 | 273 | 288 | 13967 | 13982 | GCATTTCAATGGTTGA | 61 | U | 90 |
| 1343476 | 368 | 383 | 14062 | 14077 | GAGAAGCATCACGATG | 62 | U | 788 |
| 1343513 | 372 | 387 | 14066 | 14081 | TTCAGAGAAGCATCAC | 84 | U | 697 |
| 1343516 | 395 | 410 | 14089 | 14104 | AGATCTAGAGGTTGTA | 24 | U | 1331 |
| 1343540 | 399 | 414 | 14093 | 14108 | CTGCAGATCTAGAGGT | 90 | U | 1090 |
| 1343565 | 406 | 421 | 14100 | 14115 | TGGCAAGCTGCAGATC | 53 | U | 108 |
| 1343576 | 707 | 722 | 14401 | 14416 | GAACTTGTTGGCAGTG | 48 | U | 915 |
| 1343608 | 711 | 726 | 14405 | 14420 | AAGTGAACTTGTTGGC | 20 | U | 762 |
| 1343617 | 821 | 836 | 14515 | 14530 | TACTTTGATACTTGGT | 28 | U | 680 |
| 1343618 | 825 | 840 | 14519 | 14534 | TTATTACTTTGATACT | 46 | U | 522 |
| 1343621 | 815 | 830 | 14509 | 14524 | GATACTTGGTGAAGAC | 37 | U | 34 |
| 1343624 | 563 | 578 | 14257 | 14272 | TTCATGTTTACAAGAT | 81 | U | 1495 |
| 1343627 | 994 | 1009 | 14688 | 14703 | TTCCATACTTGATTCT | 46 | U | 464 |
| 1343629 | 917 | 932 | 14611 | 14626 | GATTCTGATAGTTACT | 11 | U | 457 |
| 1343630 | 990 | 1005 | 14684 | 14699 | ATACTTGATTCTCATC | 22 | U | 647 |
| 1343631 | 915 | 930 | 14609 | 14624 | TTCTGATAGTTACTAC | 22 | U | 110 |
| 1343632 | 74 | 89 | 3336 | 3351 | ATGAAGTCTTACGGGT | 40 | U | 1140 |
| 1343633 | 913 | 928 | 14607 | 14622 | CTGATAGTTACTACAA | 36 | U | 611 |
| 1343636 | 1069 | 1084 | 14763 | 14778 | ATGTACTAGAATTCTG | 24 | U | 112 |
| 1343638 | 1016 | 1031 | 14710 | 14725 | ATGTAAGAGTATGGCC | 90 | U | 111 |
| 1343640 | 1019 | 1034 | 14713 | 14728 | ATTATGTAAGAGTATG | 85 | U | 831 |
| 1343644 | 1014 | 1029 | 14708 | 14723 | GTAAGAGTATGGCCTT | 50 | U | 36 |
| 1343646 | 1132 | 1147 | 14826 | 14841 | ATATTAACCACCAGTT | 29 | U | 38 |
| 1343648 | 1247 | 1262 | 14941 | 14956 | AAGATATAGTATGGTA | 8 | U | 45 |
| 1343649 | 1138 | 1153 | 14832 | 14847 | TGTCACATATTAACCA | 44 | U | 713 |
| 1343650 | 78 | 93 | 3340 | 3355 | TTGTATGAAGTCTTAC | 70 | U | 945 |
| 1343653 | 1136 | 1151 | 14830 | 14845 | TCACATATTAACCACC | 19 | U | 39 |
| 1343655 | 1134 | 1149 | 14828 | 14843 | ACATATTAACCACCAG | 23 | U | 188 |
| 1343658 | 1513 | 1528 | 15207 | 15222 | GACCCACGAATTGTCA | 105 | U | 1279 |
| 1343659 | 1511 | 1526 | 15205 | 15220 | CCCACGAATTGTCAGC | 40 | U | 124 |
| 1343660 | 1509 | 1524 | 15203 | 15218 | CACGAATTGTCAGCTC | 35 | U | 274 |
| 1343664 | 1506 | 1521 | 15200 | 15215 | GAATTGTCAGCTCCCC | 21 | U | 1532 |

TABLE 4-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343665 | 1504 | 1519 | 15198 | 15213 | ATTGTCAGCTCCCCTA | 15 | U | 1496 |
| 1343667 | 1520 | 1535 | 15214 | 15229 | TTTTGCGGACCCACGA | 53 | U | 1497 |
| 1343668 | 1540 | 1555 | 15234 | 15249 | AGGCTATTAGGTAGTT | 45 | U | 127 |
| 1343669 | 263 | 278 | 13957 | 13972 | GGTTGAGGCTCTTCTT | 42 | U | 251 |
| 1343671 | 1558 | 1573 | 15252 | 15267 | AGGTTTATGGTCAATA | 9 | U | 278 |
| 1343672 | 1524 | 1539 | 15218 | 15233 | AAGATTTTGCGGACCC | 26 | U | 913 |
| 1343674 | 1556 | 1571 | 15250 | 15265 | GTTTATGGTCAATAGT | 44 | U | 202 |
| 1343676 | 1564 | 1579 | 15258 | 15273 | TCAGTAAGGTTTATGG | 31 | U | 580 |
| 1343677 | N/A | N/A | 3802 | 3817 | TGTAAATAGCTCAGTT | 35 | U | 466 |
| 1343681 | N/A | N/A | 3617 | 3632 | ACCAGTAACCAGGATC | 137 | U | 296 |
| 1343683 | 2180 | 2195 | 15874 | 15889 | ATTATGCAGTATAGGT | 43 | U | 1013 |
| 1343684 | 2184 | 2199 | 15878 | 15893 | TTGGATTATGCAGTAT | 78 | U | 287 |
| 1343685 | 1562 | 1577 | 15256 | 15271 | AGTAAGGTTTATGGTC | 29 | U | 128 |
| 1343686 | N/A | N/A | 11632 | 11647 | TTTTATACATCCCATA | 87 | U | 932 |
| 1343690 | N/A | N/A | 6410 | 6425 | GGTAGTATTGAGAAAG | 33 | U | 1498 |
| 1343692 | N/A | N/A | 6406 | 6421 | GTATTGAGAAAGTCTT | 49 | U | 748 |
| 1343694 | N/A | N/A | 4209 | 4224 | AGGCATTAATAGGCAG | 67 | U | 222 |
| 1343695 | N/A | N/A | 3806 | 3821 | CAGATGTAAATAGCTC | 28 | U | 1275 |
| 1121455 | 1506 | 1521 | 15200 | 15215 | GAATTGTCAGCTCCCC | 19 | V | 198 |
| 1343234 | N/A | N/A | 11639 | 11654 | TAAGTCCTTTTATACA | 80 | V | 1505 |
| 1343239 | 556 | 571 | 14250 | 14265 | TTACAAGATCCAACAG | 110 | V | 258 |
| 1343290 | 365 | 380 | 14059 | 14074 | AAGCATCACGATGATA | 86 | V | 106 |
| 1343298 | 392 | 407 | 14086 | 14101 | TCTAGAGGTTGTAGCA | 52 | V | 370 |
| 1343317 | 401 | 416 | 14095 | 14110 | AGCTGCAGATCTAGAG | 75 | V | 1499 |
| 1343337 | 704 | 719 | 14398 | 14413 | CTTGTTGGCAGTGCAG | 42 | V | 1055 |
| 1343347 | 714 | 729 | 14408 | 14423 | ATGAAGTGAACTTGTT | 67 | V | 572 |
| 1343354 | 987 | 1002 | 14681 | 14696 | CTTGATTCTCATCAAC | 119 | V | 797 |
| 1343355 | 820 | 835 | 14514 | 14529 | ACTTTGATACTTGGTG | 52 | V | 728 |
| 1343356 | 997 | 1012 | 14691 | 14706 | CTTTTCCATACTTGAT | 49 | V | 1501 |
| 1343358 | 71 | 86 | 3333 | 3348 | AAGTCTTACGGGTGTT | 40 | V | 1228 |
| 1343360 | 919 | 934 | 14613 | 14628 | TAGATTCTGATAGTTA | 17 | V | 1500 |
| 1343362 | 828 | 843 | 14522 | 14537 | GTGTTATTACTTTGAT | 18 | V | 320 |
| 1343365 | 1141 | 1156 | 14835 | 14850 | CACTGTCACATATTAA | 39 | V | 1504 |
| 1343367 | 81 | 96 | 3343 | 3358 | GTGTTGTATGAAGTCT | 16 | V | 818 |
| 1343368 | 1131 | 1146 | 14825 | 14840 | TATTAACCACCAGTTC | 62 | V | 886 |

TABLE 4-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343370 | 1129 | 1144 | 14823 | 14838 | TTAACCACCAGTTCTC | 46 | V | 990 |
| 1343373 | 1139 | 1154 | 14833 | 14848 | CTGTCACATATTAACC | 31 | V | 1502 |
| 1343377 | 1515 | 1530 | 15209 | 15224 | CGGACCCACGAATTGT | 66 | V | 1092 |
| 1343378 | 1527 | 1542 | 15221 | 15236 | GTTAAGATTTTGCGGA | 39 | V | 51 |
| 1343379 | 1517 | 1532 | 15211 | 15226 | TGCGGACCCACGAATT | 70 | V | 275 |
| 1343382 | 1505 | 1520 | 15199 | 15214 | AATTGTCAGCTCCCCT | 17 | V | 1406 |
| 1343383 | 1501 | 1516 | 15195 | 15210 | GTCAGCTCCCCTAACC | 67 | V | 1503 |
| 1343384 | 1563 | 1578 | 15257 | 15272 | CAGTAAGGTTTATGGT | 31 | V | 638 |
| 1343386 | N/A | N/A | 3799 | 3814 | AAATAGCTCAGTTCTG | 105 | V | 560 |
| 1343390 | 1557 | 1572 | 15251 | 15266 | GGTTTATGGTCAATAG | 26 | V | 910 |
| 1343391 | N/A | N/A | 3809 | 3824 | GTTCAGATGTAAATAG | 51 | V | 1100 |
| 1343392 | 1567 | 1582 | 15261 | 15276 | TTATCAGTAAGGTTTA | 53 | V | 502 |
| 1343393 | 1553 | 1568 | 15247 | 15262 | TATGGTCAATAGTAGG | 23 | V | 1142 |
| 1343394 | N/A | N/A | 6413 | 6428 | GGAGGTAGTATTGAGA | 90 | V | 410 |
| 1343395 | N/A | N/A | 6403 | 6418 | TTGAGAAAGTCTTAAG | 87 | V | 885 |
| 1343403 | 268 | 283 | 13962 | 13977 | TCAATGGTTGAGGCTC | 51 | V | 27 |
| 1343414 | 270 | 285 | 13964 | 13979 | TTTCAATGGTTGAGGC | 50 | V | 177 |
| 1343424 | 272 | 287 | 13966 | 13981 | CATTTCAATGGTTGAG | 53 | V | 28 |
| 1343459 | 274 | 289 | 13968 | 13983 | GGCATTTCAATGGTTG | 56 | V | 178 |
| 1343466 | 276 | 291 | 13970 | 13985 | GAGGCATTTCAATGGT | 90 | V | 29 |
| 1343504 | 370 | 385 | 14064 | 14079 | CAGAGAAGCATCACGA | 46 | V | 256 |
| 1343515 | 561 | 576 | 14255 | 14270 | CATGTTTACAAGATCC | 73 | V | 91 |
| 1343531 | 397 | 412 | 14091 | 14106 | GCAGATCTAGAGGTTG | 25 | V | 32 |
| 1343550 | 404 | 419 | 14098 | 14113 | GCAAGCTGCAGATCTA | 57 | V | 1507 |
| 1343568 | 408 | 423 | 14102 | 14117 | TGTGGCAAGCTGCAGA | 92 | V | 1508 |
| 1343596 | 709 | 724 | 14403 | 14418 | GTGAACTTGTTGGCAG | 53 | V | 259 |
| 1343619 | 823 | 838 | 14517 | 14532 | ATTACTTTGATACTTG | 19 | V | 260 |
| 1343620 | 817 | 832 | 14511 | 14526 | TTGATACTTGGTGAAG | 43 | V | 895 |
| 1343623 | 813 | 828 | 14507 | 14522 | TACTTGGTGAAGACCT | 75 | V | 1045 |
| 1343626 | 916 | 931 | 14610 | 14625 | ATTCTGATAGTTACTA | 26 | V | 505 |
| 1343628 | 992 | 1007 | 14686 | 14701 | CCATACTTGATTCTCA | 24 | V | 185 |
| 1343634 | 912 | 927 | 14606 | 14621 | TGATAGTTACTACAAA | 92 | V | 655 |
| 1343635 | 914 | 929 | 14608 | 14623 | TCTGATAGTTACTACA | 24 | V | 35 |
| 1343637 | 1071 | 1086 | 14765 | 14780 | ACATGTACTAGAATTC | 83 | V | 1509 |
| 1343639 | 1067 | 1082 | 14761 | 14776 | GTACTAGAATTCTGTG | 32 | V | 37 |
| 1343641 | 76 | 91 | 3338 | 3353 | GTATGAAGTCTTACGG | 77 | V | 167 |

TABLE 4-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343642 | 1017 | 1032 | 14711 | 14726 | TATGTAAGAGTATGGC | 29 | V | 186 |
| 1343643 | 1012 | 1027 | 14706 | 14721 | AAGAGTATGGCCTTAC | 94 | V | 993 |
| 1343645 | 1015 | 1030 | 14709 | 14724 | TGTAAGAGTATGGCCT | 111 | V | 920 |
| 1343647 | 1245 | 1260 | 14939 | 14954 | GATATAGTATGGTAAG | 18 | V | 1046 |
| 1343651 | 1135 | 1150 | 14829 | 14844 | CACATATTAACCACCA | 17 | V | 264 |
| 1343652 | 1137 | 1152 | 14831 | 14846 | GTCACATATTAACCAC | 40 | V | 802 |
| 1343654 | 1133 | 1148 | 14827 | 14842 | CATATTAACCACCAGT | 20 | V | 113 |
| 1343656 | 1249 | 1264 | 14943 | 14958 | CAAAGATATAGTATGG | 18 | V | 942 |
| 1343657 | 261 | 276 | 13955 | 13970 | TTGAGGCTCTTCTTAT | 78 | V | 1506 |
| 1343661 | 1512 | 1527 | 15206 | 15221 | ACCCACGAATTGTCAG | 64 | V | 199 |
| 1343662 | 1508 | 1523 | 15202 | 15217 | ACGAATTGTCAGCTCC | 35 | V | 1374 |
| 1343663 | 1510 | 1525 | 15204 | 15219 | CCACGAATTGTCAGCT | 33 | V | 49 |
| 1343666 | 1560 | 1575 | 15254 | 15269 | TAAGGTTTATGGTCAA | 16 | V | 704 |
| 1343670 | 1538 | 1553 | 15232 | 15247 | GCTATTAGGTAGTTAA | 55 | V | 277 |
| 1343673 | 1542 | 1557 | 15236 | 15251 | GTAGGCTATTAGGTAG | 49 | V | 1367 |
| 1343675 | 1522 | 1537 | 15216 | 15231 | GATTTTGCGGACCCAC | 26 | V | 125 |
| 1343678 | N/A | N/A | 3619 | 3634 | AAACCAGTAACCAGGA | 43 | V | 1263 |
| 1343679 | N/A | N/A | 3615 | 3630 | CAGTAACCAGGATCAA | 81 | V | 444 |
| 1343680 | 265 | 280 | 13959 | 13974 | ATGGTTGAGGCTCTTC | 47 | V | 103 |
| 1343682 | 2182 | 2197 | 15876 | 15891 | GGATTATGCAGTATAG | 56 | V | 211 |
| 1343687 | N/A | N/A | 11634 | 11649 | CCTTTTATACATCCCA | 32 | V | 85 |
| 1343688 | N/A | N/A | 3804 | 3819 | GATGTAAATAGCTCAG | 39 | V | 71 |
| 1343689 | N/A | N/A | 4207 | 4222 | GCATTAATAGGCAGAA | 37 | V | 1388 |
| 1343691 | N/A | N/A | 6408 | 6423 | TAGTATTGAGAAAGTC | 64 | V | 301 |
| 1343693 | N/A | N/A | 4211 | 4226 | ATAGGCATTAATAGGC | 36 | V | 1117 |
| 1393744 | 526 | 541 | 14220 | 14235 | TAACAATAAGTTTTAG | 96 | AC | 1412 |
| 1393746 | 529 | 544 | 14223 | 14238 | TGGTAACAATAAGTTT | 51 | AC | 358 |
| 1393752 | 528 | 543 | 14222 | 14237 | GGTAACAATAAGTTTT | 23 | AC | 450 |
| 1393753 | 91 | 106 | 3353 | 3368 | ATAGAGTATTGTGTTG | 29 | AC | 636 |
| 1393754 | 1467 | 1482 | 15161 | 15176 | CTGTAGATGTAATAGA | 55 | AC | 48 |
| 1393755 | 530 | 545 | 14224 | 14239 | ATGGTAACAATAAGTT | 34 | AC | 1418 |
| 1393756 | 1461 | 1476 | 15155 | 15170 | ATGTAATAGATGGGCC | 96 | AC | 273 |
| 1393757 | 1464 | 1479 | 15158 | 15173 | TAGATGTAATAGATGG | 9 | AC | 1077 |
| 1393758 | 1462 | 1477 | 15156 | 15171 | GATGTAATAGATGGGC | 30 | AC | 1181 |
| 1393759 | 1466 | 1481 | 15160 | 15175 | TGTAGATGTAATAGAT | 30 | AC | 924 |

TABLE 4-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393760 | 1463 | 1478 | 15157 | 15172 | AGATGTAATAGATGGG | 7 | AC | 1106 |
| 1393761 | 531 | 546 | 14225 | 14240 | TATGGTAACAATAAGT | 36 | AC | 1414 |
| 1393762 | N/A | N/A | 5504 | 5519 | TGTACACGAGTATATT | 55 | AC | 1413 |
| 1393763 | 1465 | 1480 | 15159 | 15174 | GTAGATGTAATAGATG | 27 | AC | 972 |
| 1393764 | 1018 | 1033 | 14712 | 14727 | TTATGTAAGAGTATGG | 24 | AC | 262 |
| 1393765 | 1251 | 1266 | 14945 | 14960 | TCCAAAGATATAGTAT | 23 | AC | 1423 |
| 1393766 | 1246 | 1261 | 14940 | 14955 | AGATATAGTATGGTAA | 13 | AC | 270 |
| 1393768 | 1250 | 1265 | 14944 | 14959 | CCAAAGATATAGTATG | 30 | AC | 921 |
| 1393769 | 1543 | 1558 | 15237 | 15252 | AGTAGGCTATTAGGTA | 23 | AC | 1424 |
| 1393770 | 819 | 834 | 14513 | 14528 | CTTTGATACTTGGTGA | 13 | AC | 184 |
| 1393771 | 822 | 837 | 14516 | 14531 | TTACTTTGATACTTGG | 11 | AC | 612 |
| 1393772 | 1248 | 1263 | 14942 | 14957 | AAAGATATAGTATGGT | 6 | AC | 120 |
| 1393773 | 1544 | 1559 | 15238 | 15253 | TAGTAGGCTATTAGGT | 38 | AC | 1313 |
| 1393777 | 1244 | 1259 | 14938 | 14953 | ATATAGTATGGTAAGC | 47 | AC | 194 |
| 1393780 | 1243 | 1258 | 14937 | 14952 | TATAGTATGGTAAGCT | 38 | AC | 119 |
| 1393999 | 555 | 570 | 14249 | 14264 | TACAAGATCCAACAGA | 38 | AC | 888 |
| 1394005 | 1555 | 1570 | 15249 | 15264 | TTTATGGTCAATAGTA | 44 | AC | 934 |
| 1394007 | 1325 | 1340 | 15019 | 15034 | TTGCCTGCATTGGATG | 41 | AC | 1525 |
| 1394008 | N/A | N/A | 7279 | 7294 | TTTTTGGTGGTATTCC | 30 | AC | 1457 |
| 1394009 | 1554 | 1569 | 15248 | 15263 | TTATGGTCAATAGTAG | 18 | AC | 1015 |
| 1394010 | N/A | N/A | 7568 | 7583 | TTTTGACTAATGTCAT | 66 | AC | 1460 |
| 1394011 | N/A | N/A | 12092 | 12107 | GATTTGATGTTAAGTA | 27 | AC | 1458 |
| 1394012 | N/A | N/A | 11998 | 12013 | ACTTAATAGTAGTAGT | 81 | AC | 1456 |
| 1394013 | 630 | 645 | 14324 | 14339 | GTTGAGGAAATCAACA | 89 | AC | 514 |
| 1394014 | N/A | N/A | 12082 | 12097 | TAAGTACTGAAGACTG | 77 | AC | 1198 |
| 1394016 | N/A | N/A | 7558 | 7573 | TGTCATATACCATGTT | 39 | AC | 1459 |
| 1394017 | N/A | N/A | 11988 | 12003 | AGTAGTTTCCATCATG | 33 | AC | 1524 |
| 1394019 | N/A | N/A | 6937 | 6952 | TGGACTTGTGGTAATA | 40 | AC | 1526 |
| 1394020 | N/A | N/A | 6947 | 6962 | TACCCTTTTTTGGACT | 50 | AC | 1463 |
| 1394021 | N/A | N/A | 5494 | 5509 | TATATTAGGAAATTGC | 47 | AC | 1468 |
| 1394022 | N/A | N/A | 5855 | 5870 | ATTAAGAATGTAATGC | 94 | AC | 1462 |
| 1394023 | 1275 | 1290 | 14969 | 14984 | TCTGAAGTCTTAAGGT | 50 | AC | 271 |
| 1394024 | N/A | N/A | 3801 | 3816 | GTAAATAGCTCAGTTC | 31 | AC | 540 |
| 1394025 | N/A | N/A | 7354 | 7369 | TGTATATGCTGAGCAT | 47 | AC | 1291 |
| 1394026 | N/A | N/A | 5845 | 5860 | TAATGCTATGCATAAA | 70 | AC | 1461 |
| 1394027 | N/A | N/A | 3811 | 3826 | TAGTTCAGATGTAAAT | 65 | AC | 1465 |

TABLE 4-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1394028 | N/A | N/A | 5411 | 5426 | ATTTGGAGAGGTAACT | 57 | AC | 1464 |
| 1394029 | 643 | 658 | 14337 | 14352 | ATTTGTGAGCCATGTT | 8 | AC | 1469 |
| 1394030 | N/A | N/A | 7857 | 7872 | GAAATGCCAGACTCCT | 35 | AC | 1473 |
| 1394031 | 1309 | 1324 | 15003 | 15018 | TTAGGCTGGAATGGAA | 15 | AC | 1475 |
| 1394032 | N/A | N/A | 5421 | 5436 | ATATTGTCTAATTTGG | 48 | AC | 1467 |
| 1394033 | N/A | N/A | 4238 | 4253 | ACTGGAGGATAATAAC | 74 | AC | 1470 |
| 1394034 | 1605 | 1620 | 15299 | 15314 | ATATAACACGCAAAAT | 97 | AC | 1466 |
| 1394036 | 653 | 668 | 14347 | 14362 | TGGGATAGAAATTTGT | 30 | AC | 183 |
| 1394037 | N/A | N/A | 4537 | 4552 | TTGTAGTGAGCAATAG | 47 | AC | 1476 |
| 1394038 | 1503 | 1518 | 15197 | 15212 | TTGTCAGCTCCCCTAA | 10 | AC | 1527 |
| 1394039 | N/A | N/A | 7867 | 7882 | TTTGGGTGTAGAAATG | 28 | AC | 1528 |
| 1394040 | 523 | 538 | 14217 | 14232 | CAATAAGTTTTAGTCT | 54 | AC | 1474 |
| 1394041 | 93 | 108 | 3355 | 3370 | GTATAGAGTATTGTGT | 48 | AC | 244 |
| 1394042 | 1525 | 1540 | 15219 | 15234 | TAAGATTTTGCGGACC | 30 | AC | 200 |
| 1394043 | 83 | 98 | 3345 | 3360 | TTGTGTTGTATGAAGT | 15 | AC | 1530 |
| 1394044 | N/A | N/A | 5506 | 5521 | TGTGTACACGAGTATA | 47 | AC | 1531 |
| 1394045 | N/A | N/A | 4513 | 4528 | TTTGTCATAGGAATTG | 36 | AC | 1529 |
| 1394046 | N/A | N/A | 5495 | 5510 | GTATATTAGGAAATTG | 75 | AC | 1472 |
| 1394047 | N/A | N/A | 5505 | 5520 | GTGTACACGAGTATAT | 53 | AC | 1471 |
| 1394048 | 1240 | 1255 | 14934 | 14949 | AGTATGGTAAGCTAGG | 21 | AC | 1175 |
| 1394049 | 1469 | 1484 | 15163 | 15178 | AGCTGTAGATGTAATA | 43 | AC | 836 |
| 1394052 | 1459 | 1474 | 15153 | 15168 | GTAATAGATGGGCCAA | 64 | AC | 122 |
| 1394056 | 1254 | 1269 | 14948 | 14963 | GATTCCAAAGATATAG | 26 | AC | 701 |
| 1394057 | 1274 | 1289 | 14968 | 14983 | CTGAAGTCTTAAGGTT | 41 | AC | 1264 |
| 1343141 | 822 | 837 | 14516 | 14531 | TTACTTTGATACTTGG | 4 | AE | 612 |
| 1393669 | N/A | N/A | 3805 | 3820 | AGATGTAAATAGCTCA | 10 | AE | 1355 |
| 1393670 | N/A | N/A | 3807 | 3822 | TCAGATGTAAATAGCT | 28 | AE | 1225 |
| 1393671 | N/A | N/A | 3803 | 3818 | ATGTAAATAGCTCAGT | 33 | AE | 378 |
| 1393672 | N/A | N/A | 7360 | 7375 | TGATGTTGTATATGCT | 11 | AE | 1510 |
| 1393673 | N/A | N/A | 7357 | 7372 | TGTTGTATATGCTGAG | 7 | AE | 1521 |
| 1393674 | N/A | N/A | 5501 | 5516 | ACACGAGTATATTAGG | 10 | AE | 609 |
| 1393675 | N/A | N/A | 5500 | 5515 | CACGAGTATATTAGGA | 11 | AE | 675 |
| 1393676 | N/A | N/A | 5498 | 5513 | CGAGTATATTAGGAAA | 25 | AE | 1396 |
| 1393677 | N/A | N/A | 5502 | 5517 | TACACGAGTATATTAG | 36 | AE | 538 |
| 1393678 | 1608 | 1623 | 15302 | 15317 | TACATATAACACGCAA | 27 | AE | 129 |

TABLE 4-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393679 | 1610 | 1625 | 15304 | 15319 | AATACATATAACACGC | 29 | AE | 426 |
| 1393680 | 1609 | 1624 | 15303 | 15318 | ATACATATAACACGCA | 20 | AE | 1397 |
| 1393681 | 1607 | 1622 | 15301 | 15316 | ACATATAACACGCAAA | 40 | AE | 54 |
| 1393682 | N/A | N/A | 5499 | 5514 | ACGAGTATATTAGGAA | 5 | AE | 737 |
| 1393683 | N/A | N/A | 5497 | 5512 | GAGTATATTAGGAAAT | 47 | AE | 1399 |
| 1393684 | N/A | N/A | 5414 | 5429 | CTAATTTGGAGAGGTA | 19 | AE | 1202 |
| 1393685 | N/A | N/A | 4233 | 4248 | AGGATAATAACTTGAC | 24 | AE | 740 |
| 1393686 | N/A | N/A | 4235 | 4250 | GGAGGATAATAACTTG | 57 | AE | 1478 |
| 1393687 | N/A | N/A | 4232 | 4247 | GGATAATAACTTGACA | 40 | AE | 809 |
| 1393688 | 1611 | 1626 | 15305 | 15320 | TAATACATATAACACG | 37 | AE | 1398 |
| 1393689 | N/A | N/A | 4234 | 4249 | GAGGATAATAACTTGA | 51 | AE | 665 |
| 1393690 | N/A | N/A | 4231 | 4246 | GATAATAACTTGACAA | 64 | AE | 1480 |
| 1393691 | N/A | N/A | 4236 | 4251 | TGGAGGATAATAACTT | 32 | AE | 1477 |
| 1393692 | N/A | N/A | 5415 | 5430 | TCTAATTTGGAGAGGT | 65 | AE | 1149 |
| 1393693 | N/A | N/A | 5413 | 5428 | TAATTTGGAGAGGTAA | 73 | AE | 1479 |
| 1393694 | 646 | 661 | 14340 | 14355 | GAAATTTGTGAGCCAT | 10 | AE | 1486 |
| 1393695 | N/A | N/A | 5417 | 5432 | TGTCTAATTTGGAGAG | 77 | AE | 1482 |
| 1393696 | 647 | 662 | 14341 | 14356 | AGAAATTTGTGAGCCA | 14 | AE | 1485 |
| 1393697 | 645 | 660 | 14339 | 14354 | AAATTTGTGAGCCATG | 21 | AE | 1488 |
| 1393698 | 648 | 663 | 14342 | 14357 | TAGAAATTTGTGAGCC | 25 | AE | 1360 |
| 1393699 | N/A | N/A | 5416 | 5431 | GTCTAATTTGGAGAGG | 55 | AE | 1051 |
| 1393700 | N/A | N/A | 5419 | 5434 | ATTGTCTAATTTGGAG | 44 | AE | 1483 |
| 1393701 | 649 | 664 | 14343 | 14358 | ATAGAAATTTGTGAGC | 49 | AE | 1253 |
| 1393703 | N/A | N/A | 5418 | 5433 | TTGTCTAATTTGGAGA | 47 | AE | 1481 |
| 1393704 | N/A | N/A | 4544 | 4559 | TTCTTATTTGTAGTGA | 62 | AE | 1400 |
| 1393705 | N/A | N/A | 4541 | 4556 | TTATTTGTAGTGAGCA | 7 | AE | 1489 |
| 1393706 | N/A | N/A | 4545 | 4560 | GTTCTTATTTGTAGTG | 39 | AE | 1401 |
| 1393707 | 651 | 666 | 14345 | 14360 | GGATAGAAATTTGTGA | 27 | AE | 1207 |
| 1393708 | N/A | N/A | 4542 | 4557 | CTTATTTGTAGTGAGC | 23 | AE | 598 |
| 1393709 | N/A | N/A | 4540 | 4555 | TATTTGTAGTGAGCAA | 28 | AE | 1484 |
| 1393710 | N/A | N/A | 4543 | 4558 | TCTTATTTGTAGTGAG | 56 | AE | 480 |
| 1393712 | N/A | N/A | 4539 | 4554 | ATTTGTAGTGAGCAAT | 80 | AE | 1490 |
| 1393713 | 650 | 665 | 14344 | 14359 | GATAGAAATTTGTGAG | 22 | AE | 1487 |
| 1393714 | 1313 | 1328 | 15007 | 15022 | GATGTTAGGCTGGAAT | 22 | AE | 587 |
| 1393715 | 1311 | 1326 | 15005 | 15020 | TGTTAGGCTGGAATGG | 44 | AE | 46 |
| 1393716 | 1312 | 1327 | 15006 | 15021 | ATGTTAGGCTGGAATG | 55 | AE | 630 |

TABLE 4-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393717 | N/A | N/A | 7862 | 7877 | GTGTAGAAATGCCAGA | 35 | AE | 1294 |
| 1393718 | 1316 | 1331 | 15010 | 15025 | TTGGATGTTAGGCTGG | 24 | AE | 1410 |
| 1393719 | N/A | N/A | 7861 | 7876 | TGTAGAAATGCCAGAC | 22 | AE | 1404 |
| 1393720 | N/A | N/A | 7859 | 7874 | TAGAAATGCCAGACTC | 47 | AE | 359 |
| 1393721 | N/A | N/A | 7860 | 7875 | GTAGAAATGCCAGACT | 29 | AE | 1335 |
| 1393722 | 1314 | 1329 | 15008 | 15023 | GGATGTTAGGCTGGAA | 5 | AE | 519 |
| 1393723 | 1315 | 1330 | 15009 | 15024 | TGGATGTTAGGCTGGA | 12 | AE | 1511 |
| 1393724 | 1529 | 1544 | 15223 | 15238 | TAGTTAAGATTTTGCG | 18 | AE | 819 |
| 1393725 | N/A | N/A | 7864 | 7879 | GGGTGTAGAAATGCCA | 55 | AE | 1409 |
| 1393726 | 879 | 894 | 14573 | 14588 | ATAACAGATGTGAGGA | 32 | AE | 1072 |
| 1393727 | 876 | 891 | 14570 | 14585 | ACAGATGTGAGGAGTC | 12 | AE | 1407 |
| 1393728 | 875 | 890 | 14569 | 14584 | CAGATGTGAGGAGTCA | 24 | AE | 1411 |
| 1393729 | 1507 | 1522 | 15201 | 15216 | CGAATTGTCAGCTCCC | 37 | AE | 339 |
| 1393730 | 1528 | 1543 | 15222 | 15237 | AGTTAAGATTTTGCGG | 30 | AE | 1403 |
| 1393731 | N/A | N/A | 7865 | 7880 | TGGGTGTAGAAATGCC | 60 | AE | 1402 |
| 1393732 | 877 | 892 | 14571 | 14586 | AACAGATGTGAGGAGT | 14 | AE | 1136 |
| 1393733 | N/A | N/A | 7863 | 7878 | GGTGTAGAAATGCCAG | 74 | AE | 1408 |
| 1393735 | N/A | N/A | 5503 | 5518 | GTACACGAGTATATTA | 34 | AE | 1421 |
| 1393736 | N/A | N/A | 4518 | 4533 | TAACATTTGTCATAGG | 19 | AE | 828 |
| 1393737 | N/A | N/A | 4516 | 4531 | ACATTTGTCATAGGAA | 9 | AE | 1420 |
| 1393738 | N/A | N/A | 4515 | 4530 | CATTTGTCATAGGAAT | 16 | AE | 1405 |
| 1393739 | N/A | N/A | 4519 | 4534 | TTAACATTTGTCATAG | 43 | AE | 708 |
| 1393740 | 1533 | 1548 | 15227 | 15242 | TAGGTAGTTAAGATTT | 33 | AE | 613 |
| 1393741 | 1531 | 1546 | 15225 | 15240 | GGTAGTTAAGATTTTG | 7 | AE | 689 |
| 1393742 | N/A | N/A | 4517 | 4532 | AACATTTGTCATAGGA | 19 | AE | 1415 |
| 1393743 | 1530 | 1545 | 15224 | 15239 | GTAGTTAAGATTTTGC | 7 | AE | 752 |
| 1393745 | 87 | 102 | 3349 | 3364 | AGTATTGTGTTGTATG | 18 | AE | 1513 |
| 1393747 | 88 | 103 | 3350 | 3365 | GAGTATTGTGTTGTAT | 29 | AE | 756 |
| 1393748 | 86 | 101 | 3348 | 3363 | GTATTGTGTTGTATGA | 31 | AE | 1512 |
| 1393749 | 89 | 104 | 3351 | 3366 | AGAGTATTGTGTTGTA | 13 | AE | 1416 |
| 1393750 | 90 | 105 | 3352 | 3367 | TAGAGTATTGTGTTGT | 19 | AE | 1419 |
| 1343141 | 822 | 837 | 14516 | 14531 | TTACTTTGATACTTGG | 6 | AF | 612 |
| 1393584 | 562 | 577 | 14256 | 14271 | TCATGTTTACAAGATC | 49 | AF | 1515 |
| 1393585 | 1318 | 1333 | 15012 | 15027 | CATTGGATGTTAGGCT | 17 | AF | 1450 |
| 1393586 | 560 | 575 | 14254 | 14269 | ATGTTTACAAGATCCA | 6 | AF | 700 |

TABLE 4-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393589 | 557 | 572 | 14251 | 14266 | TTTACAAGATCCAACA | 32 | AF | 1395 |
| 1393590 | 1317 | 1332 | 15011 | 15026 | ATTGGATGTTAGGCTG | 46 | AF | 1514 |
| 1393593 | 558 | 573 | 14252 | 14267 | GTTTACAAGATCCAAC | 49 | AF | 33 |
| 1393594 | 1319 | 1334 | 15013 | 15028 | GCATTGGATGTTAGGC | 22 | AF | 121 |
| 1393595 | 1561 | 1576 | 15255 | 15270 | GTAAGGTTTATGGTCA | 26 | AF | 53 |
| 1393596 | 1322 | 1337 | 15016 | 15031 | CCTGCATTGGATGTTA | 36 | AF | 1516 |
| 1393598 | N/A | N/A | 11991 | 12006 | AGTAGTAGTTTCCATC | 28 | AF | 1422 |
| 1393599 | N/A | N/A | 11990 | 12005 | GTAGTAGTTTCCATCA | 40 | AF | 1417 |
| 1393600 | 1321 | 1336 | 15015 | 15030 | CTGCATTGGATGTTAG | 45 | AF | 196 |
| 1393601 | 1323 | 1338 | 15017 | 15032 | GCCTGCATTGGATGTT | 64 | AF | 1517 |
| 1393602 | 1320 | 1335 | 15014 | 15029 | TGCATTGGATGTTAGG | 39 | AF | 392 |
| 1393603 | 1559 | 1574 | 15253 | 15268 | AAGGTTTATGGTCAAT | 11 | AF | 784 |
| 1393604 | 1264 | 1279 | 14958 | 14973 | AAGGTTTCATGATTCC | 20 | AF | 632 |
| 1393606 | 1265 | 1280 | 14959 | 14974 | TAAGGTTTCATGATTC | 12 | AF | 615 |
| 1393607 | N/A | N/A | 11993 | 12008 | ATAGTAGTAGTTTCCA | 31 | AF | 1243 |
| 1393608 | 1263 | 1278 | 14957 | 14972 | AGGTTTCATGATTCCA | 19 | AF | 1427 |
| 1393609 | 1262 | 1277 | 14956 | 14971 | GGTTTCATGATTCCAA | 27 | AF | 1426 |
| 1393610 | N/A | N/A | 11995 | 12010 | TAATAGTAGTAGTTTC | 72 | AF | 1425 |
| 1393611 | N/A | N/A | 11994 | 12009 | AATAGTAGTAGTTTCC | 30 | AF | 1166 |
| 1393612 | 1266 | 1281 | 14960 | 14975 | TTAAGGTTTCATGATT | 29 | AF | 1428 |
| 1393613 | N/A | N/A | 11992 | 12007 | TAGTAGTAGTTTCCAT | 44 | AF | 1345 |
| 1393614 | 625 | 640 | 14319 | 14334 | GGAAATCAACAGTTGC | 11 | AF | 564 |
| 1393615 | 624 | 639 | 14318 | 14333 | GAAATCAACAGTTGCA | 17 | AF | 644 |
| 1393616 | N/A | N/A | 7285 | 7300 | TCAGTATTTTTGGTGG | 73 | AF | 1434 |
| 1393617 | 627 | 642 | 14321 | 14336 | GAGGAAATCAACAGTT | 20 | AF | 1430 |
| 1393618 | 1267 | 1282 | 14961 | 14976 | CTTAAGGTTTCATGAT | 63 | AF | 195 |
| 1393619 | N/A | N/A | 7284 | 7299 | CAGTATTTTTGGTGGT | 46 | AF | 642 |
| 1393620 | 623 | 638 | 14317 | 14332 | AAATCAACAGTTGCAT | 32 | AF | 1429 |
| 1393621 | N/A | N/A | 7283 | 7298 | AGTATTTTTGGTGGTA | 11 | AF | 1432 |
| 1393622 | N/A | N/A | 7282 | 7297 | GTATTTTTGGTGGTAT | 12 | AF | 1431 |
| 1393623 | 622 | 637 | 14316 | 14331 | AATCAACAGTTGCATT | 52 | AF | 1518 |
| 1393624 | N/A | N/A | 12088 | 12103 | TGATGTTAAGTACTGA | 28 | AF | 1438 |
| 1393625 | N/A | N/A | 12086 | 12101 | ATGTTAAGTACTGAAG | 52 | AF | 1437 |
| 1393626 | N/A | N/A | 12084 | 12099 | GTTAAGTACTGAAGAC | 45 | AF | 1125 |
| 1393627 | N/A | N/A | 12090 | 12105 | TTTGATGTTAAGTACT | 24 | AF | 1439 |
| 1393628 | N/A | N/A | 7286 | 7301 | TTCAGTATTTTTGGTG | 43 | AF | 1433 |

TABLE 4-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393629 | N/A | N/A | 12085 | 12100 | TGTTAAGTACTGAAGA | 63 | AF | 1436 |
| 1393630 | N/A | N/A | 12087 | 12102 | GATGTTAAGTACTGAA | 19 | AF | 1031 |
| 1393631 | N/A | N/A | 12089 | 12104 | TTGATGTTAAGTACTG | 49 | AF | 1519 |
| 1393633 | N/A | N/A | 7287 | 7302 | CTTCAGTATTTTTGGT | 70 | AF | 1435 |
| 1393634 | 539 | 554 | 14233 | 14248 | TGAATACATATGGTAA | 31 | AF | 1440 |
| 1393635 | N/A | N/A | 7560 | 7575 | AATGTCATATACCATG | 75 | AF | 1441 |
| 1393636 | N/A | N/A | 7564 | 7579 | GACTAATGTCATATAC | 92 | AF | 1244 |
| 1393637 | 538 | 553 | 14232 | 14247 | GAATACATATGGTAAC | 53 | AF | 1386 |
| 1393638 | N/A | N/A | 7562 | 7577 | CTAATGTCATATACCA | 24 | AF | 353 |
| 1393639 | N/A | N/A | 7565 | 7580 | TGACTAATGTCATATA | 117 | AF | 1443 |
| 1393640 | N/A | N/A | 7563 | 7578 | ACTAATGTCATATACC | 40 | AF | 1344 |
| 1393641 | N/A | N/A | 7566 | 7581 | TTGACTAATGTCATAT | 112 | AF | 1444 |
| 1393642 | N/A | N/A | 7561 | 7576 | TAATGTCATATACCAT | 32 | AF | 1442 |
| 1393643 | 541 | 556 | 14235 | 14250 | GATGAATACATATGGT | 17 | AF | 1262 |
| 1393644 | 1565 | 1580 | 15259 | 15274 | ATCAGTAAGGTTTATG | 28 | AF | 203 |
| 1393645 | 1269 | 1284 | 14963 | 14978 | GTCTTAAGGTTTCATG | 24 | AF | 454 |
| 1393646 | 1268 | 1283 | 14962 | 14977 | TCTTAAGGTTTCATGA | 53 | AF | 533 |
| 1393647 | N/A | N/A | 5848 | 5863 | ATGTAATGCTATGCAT | 87 | AF | 1448 |
| 1393648 | 1272 | 1287 | 14966 | 14981 | GAAGTCTTAAGGTTTC | 60 | AF | 1391 |
| 1393649 | 1566 | 1581 | 15260 | 15275 | TATCAGTAAGGTTTAT | 52 | AF | 1445 |
| 1393650 | N/A | N/A | 5847 | 5862 | TGTAATGCTATGCATA | 49 | AF | 1447 |
| 1393652 | 1270 | 1285 | 14964 | 14979 | AGTCTTAAGGTTTCAT | 14 | AF | 338 |
| 1393653 | 1271 | 1286 | 14965 | 14980 | AAGTCTTAAGGTTTCA | 26 | AF | 1446 |
| 1393654 | N/A | N/A | 6941 | 6956 | TTTTTGGACTTGTGGT | 34 | AF | 1451 |
| 1393655 | N/A | N/A | 6943 | 6958 | CTTTTTTGGACTTGTG | 5 | AF | 77 |
| 1393656 | N/A | N/A | 6942 | 6957 | TTTTTTGGACTTGTGG | 17 | AF | 585 |
| 1393657 | N/A | N/A | 6939 | 6954 | TTTGGACTTGTGGTAA | 42 | AF | 1520 |
| 1393658 | N/A | N/A | 5850 | 5865 | GAATGTAATGCTATGC | 25 | AF | 732 |
| 1393659 | N/A | N/A | 6940 | 6955 | TTTTGGACTTGTGGTA | 29 | AF | 1522 |
| 1393660 | N/A | N/A | 6945 | 6960 | CCCTTTTTTGGACTTG | 21 | AF | 1453 |
| 1393661 | N/A | N/A | 5851 | 5866 | AGAATGTAATGCTATG | 35 | AF | 1449 |
| 1393662 | N/A | N/A | 6944 | 6959 | CCTTTTTTGGACTTGT | 5 | AF | 1452 |
| 1393663 | N/A | N/A | 7356 | 7371 | GTTGTATATGCTGAGC | 17 | AF | 1454 |
| 1393664 | N/A | N/A | 7361 | 7376 | ATGATGTTGTATATGC | 15 | AF | 1523 |
| 1393665 | N/A | N/A | 7359 | 7374 | GATGTTGTATATGCTG | 19 | AF | 1187 |

TABLE 4-continued

Reduction of PLN RNA by modified oligonucleotides with a mixed MOE/cEt sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393666 | N/A | N/A | 7362 | 7377 | AATGATGTTGTATATG | 58 | AF | 1393 |
| 1393667 | N/A | N/A | 3808 | 3823 | TTCAGATGTAAATAGC | 33 | AF | 1394 |
| 1393668 | N/A | N/A | 7358 | 7373 | ATGTTGTATATGCTGA | 20 | AF | 1455 |

Example 5: Effect of Mixed cEt and 2'-OMe, Uniform Phosphorothioate Modified Oligonucleotides on Human PLN RNA In Vitro, Single Dose Modified oligonucleotides complementary to human PLN nucleic acid were designed and tested for their single dose effects on PLN RNA in vitro. The modified oligonucleotides were tested in a series of experiments that had the same culture conditions.

The modified oligonucleotides in the table below are 16 nucleosides in length, wherein the sugar motif for the modified oligonucleotides is (from 5' to 3'): kkkdyddddddddkkk; wherein each "d" represents a 2'-β-D-deoxyribosyl sugar moiety, each "y" represents a 2'-OMe sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine unless otherwise marked; non-methylated cytosine residues are indicated by a bolded and underlined C.

"Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the table below is 100% complementary to SEQ ID NO: 1 (described herein above), to SEQ ID NO: 2 (described herein above), or to both. "N/A" indicates that the modified oligonucleotide is not 100% complementary to that particular target nucleic acid sequence.

Cultured iCell® cardiomyocytes[2] (FujiFilm Cellular Dynamics, Inc.; Catalog No: R1017) were treated with modified oligonucleotide at a concentration of 6000 nM by free uptake at a density of 8,000 cells per well. After a treatment period of approximately 72 hours, total RNA was isolated from the cells and PLN RNA levels were measured by quantitative real-time RTPCR. PLN RNA levels were measured by human primer-probe set RTS40402 (described herein above). PLN RNA levels were normalized to total RNA content, as measured by RIBOGREEN®. Reduction of PLN RNA is presented in the table below as percent PLN RNA relative to the amount in untreated control cells (% UTC).

Each separate experimental analysis described in this example is identified by a letter ID in the table column below labeled "AID" (Analysis ID). In the table below, Compound Nos. 1121455 and 1343141 (described herein above) were used as benchmarks.

TABLE 5

Reduction of PLN RNA by modified oligonucleotides with a mixed cEt/2'-OMe sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121455 | 1506 | 1521 | 15200 | 15215 | GAATTGTCAGCTCCCC | 15 | W | 198 |
| 1343295 | 279 | 294 | 13973 | 13988 | GTTGAGGCATTTCAAT | 83 | W | 1324 |
| 1343296 | 258 | 273 | 13952 | 13967 | AGGCUCTTCTTATAGC | 83 | W | 1532 |
| 1343299 | 266 | 281 | 13960 | 13975 | AATGGTTGAGGCTCTT | 65 | W | 176 |
| 1343300 | 275 | 290 | 13969 | 13984 | AGGCATTTCAATGGTT | 28 | W | 254 |
| 1343304 | 909 | 924 | 14603 | 14618 | TAGTUACTACAAATAG | 54 | W | 1533 |
| 1343307 | 818 | 833 | 14512 | 14527 | TTTGATACTTGGTGAA | 51 | W | 794 |
| 1343310 | 810 | 825 | 14504 | 14519 | TTGGUGAAGACCTGAA | 63 | W | 1534 |
| 1343311 | 411 | 426 | 14105 | 14120 | TGATGTGGCAAGCTGC | 43 | W | 1493 |
| 1343313 | 402 | 417 | 14096 | 14111 | AAGCUGCAGATCTAGA | 70 | W | 1535 |

TABLE 5-continued

Reduction of PLN RNA by modified oligonucleotides with a mixed cEt/2'-OMe sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343318 | 1009 | 1024 | 14703 | 14718 | AGTAUGGCCTTACTTT | 83 | W | 1536 |
| 1343319 | 1074 | 1089 | 14768 | 14783 | CCTACATGTACTAGAA | 48 | W | 1272 |
| 1343320 | 920 | 935 | 14614 | 14629 | GTAGATTCTGATAGTT | 28 | W | 1319 |
| 1343325 | 1140 | 1155 | 14834 | 14849 | ACTGUCACATATTAAC | 90 | W | 1537 |
| 1343329 | 1252 | 1267 | 14946 | 14961 | TTCCAAAGATATAGTA | 38 | W | 812 |
| 1343330 | 1242 | 1257 | 14936 | 14951 | ATAGUATGGTAAGCTA | 83 | W | 1538 |
| 1343333 | 1130 | 1145 | 14824 | 14839 | ATTAACCACCAGTTCT | 33 | W | 263 |
| 1343335 | 1545 | 1560 | 15239 | 15254 | ATAGUAGGCTATTAGG | 82 | W | 1539 |
| 1343340 | 1516 | 1531 | 15210 | 15225 | GCGGACCCACGAATTG | 47 | W | 1083 |
| 1343342 | 1535 | 1550 | 15229 | 15244 | ATTAGGTAGTTAAGAT | 62 | W | 126 |
| 1343344 | N/A | N/A | 4214 | 4229 | ACTAUAGGCATTAATA | 82 | W | 1540 |
| 1343345 | N/A | N/A | 3612 | 3627 | TAACCAGGATCAAAGA | 75 | W | 562 |
| 1343350 | N/A | N/A | 4204 | 4219 | TTAAUAGGCAGAAATC | 69 | W | 1541 |
| 1343351 | N/A | N/A | 3622 | 3637 | GACAAACCAGTAACCA | 25 | W | 1099 |
| 1343506 | 78 | 93 | 3340 | 3355 | TTGTATGAAGTCTTAC | 86 | W | 945 |
| 1343509 | 559 | 574 | 14253 | 14268 | TGTTUACAAGATCCAA | 29 | W | 1542 |
| 1343510 | 563 | 578 | 14257 | 14272 | TTCAUGTTTACAAGAT | 65 | W | 1543 |
| 1343512 | 74 | 89 | 3336 | 3351 | ATGAAGTCTTACGGGT | 26 | W | 1140 |
| 1343517 | 273 | 288 | 13967 | 13982 | GCATUTCAATGGTTGA | 54 | W | 1544 |
| 1343518 | 271 | 286 | 13965 | 13980 | ATTTCAATGGTTGAGG | 60 | W | 253 |
| 1343519 | 269 | 284 | 13963 | 13978 | TTCAATGGTTGAGGCT | 41 | W | 104 |
| 1343523 | 263 | 278 | 13957 | 13972 | GGTTGAGGCTCTTCTT | 24 | W | 251 |
| 1343527 | 399 | 414 | 14093 | 14108 | CTGCAGATCTAGAGGT | 80 | W | 1090 |
| 1343529 | 372 | 387 | 14066 | 14081 | TTCAGAGAAGCATCAC | 55 | W | 697 |
| 1343532 | 395 | 410 | 14089 | 14104 | AGATCTAGAGGTTGTA | 79 | W | 1331 |
| 1343533 | 368 | 383 | 14062 | 14077 | GAGAAGCATCACGATG | 65 | W | 788 |
| 1343536 | 707 | 722 | 14401 | 14416 | GAACUTGTTGGCAGTG | 41 | W | 1545 |
| 1343537 | 821 | 836 | 14515 | 14530 | TACTUTGATACTTGGT | 35 | W | 1546 |
| 1343542 | 815 | 830 | 14509 | 14524 | GATACTTGGTGAAGAC | 25 | W | 34 |
| 1343544 | 406 | 421 | 14100 | 14115 | TGGCAAGCTGCAGATC | 41 | W | 108 |
| 1343545 | 711 | 726 | 14405 | 14420 | AAGTGAACTTGTTGGC | 48 | W | 762 |
| 1343546 | 990 | 1005 | 14684 | 14699 | ATACUTGATTCTCATC | 34 | W | 1547 |
| 1343548 | 917 | 932 | 14611 | 14626 | GATTCTGATAGTTACT | 21 | W | 457 |
| 1343551 | 915 | 930 | 14609 | 14624 | TTCTGATAGTTACTAC | 37 | W | 110 |
| 1343552 | 913 | 928 | 14607 | 14622 | CTGAUAGTTACTACAA | 35 | W | 1548 |

TABLE 5-continued

Reduction of PLN RNA by modified oligonucleotides with a mixed cEt/2'-OMe sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343554 | 825 | 840 | 14519 | 14534 | TTATUACTTTGATACT | 55 | W | 1549 |
| 1343558 | 1014 | 1029 | 14708 | 14723 | GTAAGAGTATGGCCTT | 17 | W | 36 |
| 1343559 | 1019 | 1034 | 14713 | 14728 | ATTAUGTAAGAGTATG | 91 | W | 1550 |
| 1343563 | 1016 | 1031 | 14710 | 14725 | ATGTAAGAGTATGGCC | 64 | W | 111 |
| 1343564 | 994 | 1009 | 14688 | 14703 | TTCCATACTTGATTCT | 45 | W | 464 |
| 1343567 | 1138 | 1153 | 14832 | 14847 | TGTCACATATTAACCA | 44 | W | 713 |
| 1343571 | 1136 | 1151 | 14830 | 14845 | TCACATATTAACCACC | 21 | W | 39 |
| 1343573 | 1132 | 1147 | 14826 | 14841 | ATATUAACCACCAGTT | 91 | W | 1551 |
| 1343574 | 1134 | 1149 | 14828 | 14843 | ACATATTAACCACCAG | 23 | W | 188 |
| 1343575 | 1069 | 1084 | 14763 | 14778 | ATGTACTAGAATTCTG | 45 | W | 112 |
| 1343578 | 1247 | 1262 | 14941 | 14956 | AAGAUATAGTATGGTA | 37 | W | 1552 |
| 1343581 | 1509 | 1524 | 15203 | 15218 | CACGAATTGTCAGCTC | 32 | W | 274 |
| 1343583 | 1506 | 1521 | 15200 | 15215 | GAATUGTCAGCTCCCC | 20 | W | 1553 |
| 1343585 | 1504 | 1519 | 15198 | 15213 | ATTGUCAGCTCCCCTA | 59 | W | 1554 |
| 1343586 | 1556 | 1571 | 15250 | 15265 | GTTTATGGTCAATAGT | 41 | W | 202 |
| 1343587 | 1520 | 1535 | 15214 | 15229 | TTTTGCGGACCCACGA | 69 | W | 1497 |
| 1343588 | 1558 | 1573 | 15252 | 15267 | AGGTUTATGGTCAATA | 53 | W | 1555 |
| 1343590 | 1540 | 1555 | 15234 | 15249 | AGGCUATTAGGTAGTT | 47 | W | 1556 |
| 1343592 | 1513 | 1528 | 15207 | 15222 | GACCCACGAATTGTCA | 82 | W | 1279 |
| 1343593 | 1511 | 1526 | 15205 | 15220 | CCCACGAATTGTCAGC | 54 | W | 124 |
| 1343595 | 1524 | 1539 | 15218 | 15233 | AAGAUTTTGCGGACCC | 22 | W | 1557 |
| 1343598 | N/A | N/A | 3617 | 3632 | ACCAGTAACCAGGATC | 66 | W | 296 |
| 1343599 | 1562 | 1577 | 15256 | 15271 | AGTAAGGTTTATGGTC | 43 | W | 128 |
| 1343601 | 2184 | 2199 | 15878 | 15893 | TTGGATTATGCAGTAT | 62 | W | 287 |
| 1343604 | 1564 | 1579 | 15258 | 15273 | TCAGUAAGGTTTATGG | 61 | W | 1558 |
| 1343605 | 2180 | 2195 | 15874 | 15889 | ATTAUGCAGTATAGGT | 66 | W | 1559 |
| 1343606 | N/A | N/A | 6410 | 6425 | GGTAGTATTGAGAAAG | 38 | W | 1498 |
| 1343611 | N/A | N/A | 6406 | 6421 | GTATUGAGAAAGTCTT | 40 | W | 1560 |
| 1343612 | N/A | N/A | 4209 | 4224 | AGGCATTAATAGGCAG | 43 | W | 222 |
| 1343613 | N/A | N/A | 3806 | 3821 | CAGAUGTAAATAGCTC | 41 | W | 1561 |
| 1343615 | N/A | N/A | 3802 | 3817 | TGTAAATAGCTCAGTT | 38 | W | 466 |
| 1343616 | N/A | N/A | 11632 | 11647 | TTTTATACATCCCATA | 116 | W | 932 |
| 1343625 | N/A | N/A | 11636 | 11651 | GTCCUTTTATACATCC | 50 | W | 1562 |
| 1121455 | 1506 | 1521 | 15200 | 15215 | GAATTGTCAGCTCCCC | 15 | X | 198 |
| 1343294 | 392 | 407 | 14086 | 14101 | TCTAGAGGTTGTAGCA | 92 | X | 370 |
| 1343297 | 365 | 380 | 14059 | 14074 | AAGCATCACGATGATA | 68 | X | 106 |

TABLE 5-continued

Reduction of PLN RNA by modified oligonucleotides with a mixed cEt/2'-OMe sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343301 | 81 | 96 | 3343 | 3358 | GTGTUGTATGAAGTCT | 34 | X | 1563 |
| 1343302 | 556 | 571 | 14250 | 14265 | TTACAAGATCCAACAG | 46 | X | 258 |
| 1343303 | 71 | 86 | 3333 | 3348 | AAGTCTTACGGGTGTT | 40 | X | 1228 |
| 1343305 | 401 | 416 | 14095 | 14110 | AGCTGCAGATCTAGAG | 106 | X | 1499 |
| 1343306 | 828 | 843 | 14522 | 14537 | GTGTUATTACTTTGAT | 72 | X | 1564 |
| 1343308 | 820 | 835 | 14514 | 14529 | ACTTUGATACTTGGTG | 85 | X | 1565 |
| 1343309 | 714 | 729 | 14408 | 14423 | ATGAAGTGAACTTGTT | 56 | X | 572 |
| 1343312 | 704 | 719 | 14398 | 14413 | CTTGUTGGCAGTGCAG | 43 | X | 1566 |
| 1343314 | 1129 | 1144 | 14823 | 14838 | TTAACCACCAGTTCTC | 69 | X | 990 |
| 1343316 | 1139 | 1154 | 14833 | 14848 | CTGTCACATATTAACC | 57 | X | 1502 |
| 1343321 | 997 | 1012 | 14691 | 14706 | CTTTUCCATACTTGAT | 56 | X | 1567 |
| 1343322 | 919 | 934 | 14613 | 14628 | TAGAUTCTGATAGTTA | 32 | X | 1568 |
| 1343323 | 987 | 1002 | 14681 | 14696 | CTTGATTCTCATCAAC | 65 | X | 797 |
| 1343324 | 1515 | 1530 | 15209 | 15224 | CGGACCCACGAATTGT | 52 | X | 1092 |
| 1343326 | 1505 | 1520 | 15199 | 15214 | AATTGTCAGCTCCCCT | 30 | X | 1406 |
| 1343327 | 1501 | 1516 | 15195 | 15210 | GTCAGCTCCCCTAACC | 92 | X | 1503 |
| 1343331 | 1141 | 1156 | 14835 | 14850 | CACTGTCACATATTAA | 38 | X | 1504 |
| 1343332 | 1131 | 1146 | 14825 | 14840 | TATTAACCACCAGTTC | 69 | X | 886 |
| 1343334 | 1557 | 1572 | 15251 | 15266 | GGTTUATGGTCAATAG | 41 | X | 1569 |
| 1343336 | 1567 | 1582 | 15261 | 15276 | TTATCAGTAAGGTTTA | 51 | X | 502 |
| 1343338 | 1517 | 1532 | 15211 | 15226 | TGCGGACCCACGAATT | 56 | X | 275 |
| 1343339 | 1553 | 1568 | 15247 | 15262 | TATGGTCAATAGTAGG | 10 | X | 1142 |
| 1343341 | 1563 | 1578 | 15257 | 15272 | CAGTAAGGTTTATGGT | 50 | X | 638 |
| 1343343 | 1527 | 1542 | 15221 | 15236 | GTTAAGATTTTGCGGA | 41 | X | 51 |
| 1343346 | N/A | N/A | 11639 | 11654 | TAAGUCCTTTTATACA | 81 | X | 1570 |
| 1343348 | N/A | N/A | 6413 | 6428 | GGAGGTAGTATTGAGA | 93 | X | 410 |
| 1343349 | N/A | N/A | 6403 | 6418 | TTGAGAAAGTCTTAAG | 93 | X | 885 |
| 1343352 | N/A | N/A | 3809 | 3824 | GTTCAGATGTAAATAG | 57 | X | 1100 |
| 1343353 | N/A | N/A | 3799 | 3814 | AAATAGCTCAGTTCTG | 48 | X | 560 |
| 1343507 | 561 | 576 | 14255 | 14270 | CATGUTTACAAGATCC | 39 | X | 1571 |
| 1343511 | 76 | 91 | 3338 | 3353 | GTATGAAGTCTTACGG | 66 | X | 167 |
| 1343520 | 272 | 287 | 13966 | 13981 | CATTUCAATGGTTGAG | 61 | X | 1572 |
| 1343521 | 270 | 285 | 13964 | 13979 | TTTCAATGGTTGAGGC | 36 | X | 177 |
| 1343522 | 268 | 283 | 13962 | 13977 | TCAAUGGTTGAGGCTC | 59 | X | 1573 |
| 1343524 | 265 | 280 | 13959 | 13974 | ATGGUTGAGGCTCTTC | 41 | X | 1574 |

TABLE 5-continued

Reduction of PLN RNA by modified oligonucleotides with a mixed cEt/2'-OMe sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343525 | 261 | 276 | 13955 | 13970 | TTGAGGCTCTTCTTAT | 81 | X | 1506 |
| 1343526 | 274 | 289 | 13968 | 13983 | GGCAUTTCAATGGTTG | 46 | X | 1575 |
| 1343528 | 404 | 419 | 14098 | 14113 | GCAAGCTGCAGATCTA | 23 | X | 1507 |
| 1343530 | 276 | 291 | 13970 | 13985 | GAGGCATTTCAATGGT | 46 | X | 29 |
| 1343534 | 370 | 385 | 14064 | 14079 | CAGAGAAGCATCACGA | 70 | X | 256 |
| 1343535 | 397 | 412 | 14091 | 14106 | GCAGATCTAGAGGTTG | 16 | X | 32 |
| 1343538 | 817 | 832 | 14511 | 14526 | TTGAUACTTGGTGAAG | 63 | X | 1576 |
| 1343539 | 408 | 423 | 14102 | 14117 | TGTGGCAAGCTGCAGA | 69 | X | 1508 |
| 1343541 | 813 | 828 | 14507 | 14522 | TACTUGGTGAAGACCT | 61 | X | 1577 |
| 1343543 | 709 | 724 | 14403 | 14418 | GTGAACTTGTTGGCAG | 37 | X | 259 |
| 1343547 | 823 | 838 | 14517 | 14532 | ATTACTTTGATACTTG | 17 | X | 260 |
| 1343549 | 914 | 929 | 14608 | 14623 | TCTGATAGTTACTACA | 38 | X | 35 |
| 1343553 | 916 | 931 | 14610 | 14625 | ATTCUGATAGTTACTA | 62 | X | 1578 |
| 1343555 | 912 | 927 | 14606 | 14621 | TGATAGTTACTACAAA | 74 | X | 655 |
| 1343556 | 1015 | 1030 | 14709 | 14724 | TGTAAGAGTATGGCCT | 42 | X | 920 |
| 1343557 | 1067 | 1082 | 14761 | 14776 | GTACUAGAATTCTGTG | 68 | X | 1579 |
| 1343560 | 1017 | 1032 | 14711 | 14726 | TATGUAAGAGTATGGC | 40 | X | 1580 |
| 1343561 | 1012 | 1027 | 14706 | 14721 | AAGAGTATGGCCTTAC | 88 | X | 993 |
| 1343562 | 992 | 1007 | 14686 | 14701 | CCATACTTGATTCTCA | 38 | X | 185 |
| 1343566 | 1071 | 1086 | 14765 | 14780 | ACATGTACTAGAATTC | 73 | X | 1509 |
| 1343569 | 1135 | 1150 | 14829 | 14844 | CACAUATTAACCACCA | 31 | X | 1581 |
| 1343570 | 1137 | 1152 | 14831 | 14846 | GTCACATATTAACCAC | 30 | X | 802 |
| 1343572 | 1133 | 1148 | 14827 | 14842 | CATAUTAACCACCAGT | 48 | X | 1582 |
| 1343577 | 1510 | 1525 | 15204 | 15219 | CCACGAATTGTCAGCT | 46 | X | 49 |
| 1343579 | 1512 | 1527 | 15206 | 15221 | ACCCACGAATTGTCAG | 44 | X | 199 |
| 1343580 | 1249 | 1264 | 14943 | 14958 | CAAAGATATAGTATGG | 15 | X | 942 |
| 1343582 | 1508 | 1523 | 15202 | 15217 | ACGAATTGTCAGCTCC | 17 | X | 1374 |
| 1343584 | 1245 | 1260 | 14939 | 14954 | GATAUAGTATGGTAAG | 33 | X | 1583 |
| 1343589 | 1542 | 1557 | 15236 | 15251 | GTAGGCTATTAGGTAG | 37 | X | 1367 |
| 1343591 | 1538 | 1553 | 15232 | 15247 | GCTAUTAGGTAGTTAA | 50 | X | 1584 |
| 1343594 | 1522 | 1537 | 15216 | 15231 | GATTUTGCGGACCCAC | 44 | X | 1585 |
| 1343597 | N/A | N/A | 3619 | 3634 | AAACCAGTAACCAGGA | 57 | X | 1263 |
| 1343600 | 2182 | 2197 | 15876 | 15891 | GGATUATGCAGTATAG | 54 | X | 1586 |
| 1343602 | N/A | N/A | 3615 | 3630 | CAGTAACCAGGATCAA | 63 | X | 444 |
| 1343603 | 1560 | 1575 | 15254 | 15269 | TAAGGTTTATGGTCAA | 20 | X | 704 |
| 1343607 | N/A | N/A | 6408 | 6423 | TAGTATTGAGAAAGTC | 53 | X | 301 |

TABLE 5-continued

Reduction of PLN RNA by modified oligonucleotides with a mixed cEt/2'-OMe sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343609 | N/A | N/A | 4211 | 4226 | ATAGGCATTAATAGGC | 68 | X | 1117 |
| 1343610 | N/A | N/A | 4207 | 4222 | GCATUAATAGGCAGAA | 104 | X | 1587 |
| 1343614 | N/A | N/A | 3804 | 3819 | GATGUAAATAGCTCAG | 66 | X | 1588 |
| 1343622 | N/A | N/A | 11634 | 11649 | CCTTUTATACATCCCA | 46 | X | 1589 |
| 1393872 | N/A | N/A | 4231 | 4246 | GATAATAACTTGACAA | 57 | AD | 1480 |
| 1393875 | N/A | N/A | 5415 | 5430 | TCTAATTTGGAGAGGT | 56 | AD | 1149 |
| 1393878 | N/A | N/A | 5416 | 5431 | GTCTAATTTGGAGAGG | 36 | AD | 1051 |
| 1393879 | N/A | N/A | 4236 | 4251 | TGGAGGATAATAACTT | 55 | AD | 1477 |
| 1393880 | N/A | N/A | 4234 | 4249 | GAGGATAATAACTTGA | 65 | AD | 665 |
| 1393881 | N/A | N/A | 4232 | 4247 | GGATAATAACTTGACA | 82 | AD | 809 |
| 1393882 | N/A | N/A | 4235 | 4250 | GGAGGATAATAACTTG | 38 | AD | 1478 |
| 1393885 | 647 | 662 | 14341 | 14356 | AGAAATTTGTGAGCCA | 8 | AD | 1485 |
| 1393888 | 649 | 664 | 14343 | 14358 | ATAGAAATTTGTGAGC | 29 | AD | 1253 |
| 1393890 | 650 | 665 | 14344 | 14359 | GATAGAAATTTGTGAG | 63 | AD | 1487 |
| 1393892 | 648 | 663 | 14342 | 14357 | TAGAAATTTGTGAGCC | 13 | AD | 1360 |
| 1393896 | 1311 | 1326 | 15005 | 15020 | TGTTAGGCTGGAATGG | 29 | AD | 46 |
| 1393898 | N/A | N/A | 4539 | 4554 | ATTTGTAGTGAGCAAT | 78 | AD | 1490 |
| 1393899 | N/A | N/A | 4543 | 4558 | TCTTATTTGTAGTGAG | 62 | AD | 480 |
| 1393902 | 651 | 666 | 14345 | 14360 | GGATAGAAATTTGTGA | 50 | AD | 1207 |
| 1393904 | N/A | N/A | 7862 | 7877 | GTGTAGAAATGCCAGA | 37 | AD | 1294 |
| 1393905 | N/A | N/A | 7859 | 7874 | TAGAAATGCCAGACTC | 33 | AD | 359 |
| 1393906 | 1316 | 1331 | 15010 | 15025 | TTGGATGTTAGGCTGG | 6 | AD | 1410 |
| 1393907 | 1314 | 1329 | 15008 | 15023 | GGATGTTAGGCTGGAA | 32 | AD | 519 |
| 1393909 | N/A | N/A | 7864 | 7879 | GGGTGTAGAAATGCCA | 110 | AD | 1409 |
| 1393911 | N/A | N/A | 7860 | 7875 | GTAGAAATGCCAGACT | 37 | AD | 1335 |
| 1393913 | N/A | N/A | 7861 | 7876 | TGTAGAAATGCCAGAC | 53 | AD | 1404 |
| 1393916 | 876 | 891 | 14570 | 14585 | ACAGATGTGAGGAGTC | 19 | AD | 1407 |
| 1393917 | 877 | 892 | 14571 | 14586 | AACAGATGTGAGGAGT | 27 | AD | 1136 |
| 1393918 | 1528 | 1543 | 15222 | 15237 | AGTTAAGATTTTGCGG | 32 | AD | 1403 |
| 1393924 | 1531 | 1546 | 15225 | 15240 | GGTAGTTAAGATTTTG | 10 | AD | 689 |
| 1393929 | N/A | N/A | 4518 | 4533 | TAACATTTGTCATAGG | 30 | AD | 828 |
| 1393930 | N/A | N/A | 5503 | 5518 | GTACACGAGTATATTA | 42 | AD | 1421 |
| 1393936 | 88 | 103 | 3350 | 3365 | GAGTATTGTGTTGTAT | 26 | AD | 756 |
| 1393937 | 526 | 541 | 14220 | 14235 | TAACAATAAGTTTTAG | 69 | AD | 1412 |
| 1393939 | 90 | 105 | 3352 | 3367 | TAGAGTATTGTGTTGT | 23 | AD | 1419 |

TABLE 5-continued

Reduction of PLN RNA by modified oligonucleotides with a mixed cEt/2'-OMe sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393941 | 529 | 544 | 14223 | 14238 | TGGTAACAATAAGTTT | 42 | AD | 358 |
| 1393942 | 91 | 106 | 3353 | 3368 | ATAGAGTATTGTGTTG | 42 | AD | 636 |
| 1393943 | 528 | 543 | 14222 | 14237 | GGTAACAATAAGTTTT | 50 | AD | 450 |
| 1393944 | 1467 | 1482 | 15161 | 15176 | CTGTAGATGTAATAGA | 74 | AD | 48 |
| 1393945 | 1465 | 1480 | 15159 | 15174 | GTAGATGTAATAGATG | 25 | AD | 972 |
| 1393947 | 531 | 546 | 14225 | 14240 | TATGGTAACAATAAGT | 73 | AD | 1414 |
| 1393948 | 1461 | 1476 | 15155 | 15170 | ATGTAATAGATGGGCC | 88 | AD | 273 |
| 1393951 | 1463 | 1478 | 15157 | 15172 | AGATGTAATAGATGGG | 36 | AD | 1106 |
| 1393952 | 1466 | 1481 | 15160 | 15175 | TGTAGATGTAATAGAT | 27 | AD | 924 |
| 1393954 | 819 | 834 | 14513 | 14528 | CTTTGATACTTGGTGA | 30 | AD | 184 |
| 1393955 | 1544 | 1559 | 15238 | 15253 | TAGTAGGCTATTAGGT | 61 | AD | 1313 |
| 1393957 | 1543 | 1558 | 15237 | 15252 | AGTAGGCTATTAGGTA | 26 | AD | 1424 |
| 1394051 | N/A | N/A | 11988 | 12003 | AGTAGTTTCCATCATG | 33 | AD | 1524 |
| 1394054 | 555 | 570 | 14249 | 14264 | TACAAGATCCAACAGA | 53 | AD | 888 |
| 1394058 | 1554 | 1569 | 15248 | 15263 | TTATGGTCAATAGTAG | 27 | AD | 1015 |
| 1394060 | N/A | N/A | 7558 | 7573 | TGTCATATACCATGTT | 65 | AD | 1459 |
| 1394062 | 1275 | 1290 | 14969 | 14984 | TCTGAAGTCTTAAGGT | 36 | AD | 271 |
| 1394064 | N/A | N/A | 7568 | 7583 | TTTTGACTAATGTCAT | 94 | AD | 1460 |
| 1394066 | N/A | N/A | 11998 | 12013 | ACTTAATAGTAGTAGT | 105 | AD | 1456 |
| 1394067 | 630 | 645 | 14324 | 14339 | GTTGAGGAAATCAACA | 94 | AD | 514 |
| 1394071 | N/A | N/A | 5855 | 5870 | ATTAAGAATGTAATGC | 70 | AD | 1462 |
| 1394072 | 1605 | 1620 | 15299 | 15314 | ATATAACACGCAAAAT | 83 | AD | 1466 |
| 1394073 | N/A | N/A | 5845 | 5860 | TAATGCTATGCATAAA | 98 | AD | 1461 |
| 1394076 | N/A | N/A | 3801 | 3816 | GTAAATAGCTCAGTTC | 50 | AD | 540 |
| 1394078 | N/A | N/A | 7867 | 7882 | TTTGGGTGTAGAAATG | 81 | AD | 1528 |
| 1394079 | 643 | 658 | 14337 | 14352 | ATTTGTGAGCCATGTT | 23 | AD | 1469 |
| 1394080 | 653 | 668 | 14347 | 14362 | TGGGATAGAAATTTGT | 44 | AD | 183 |
| 1394081 | N/A | N/A | 4238 | 4253 | ACTGGAGGATAATAAC | 77 | AD | 1470 |
| 1394084 | 1309 | 1324 | 15003 | 15018 | TTAGGCTGGAATGGAA | 41 | AD | 1475 |
| 1394085 | N/A | N/A | 5411 | 5426 | ATTTGGAGAGGTAACT | 111 | AD | 1464 |
| 1394087 | N/A | N/A | 4537 | 4552 | TTGTAGTGAGCAATAG | 30 | AD | 1476 |
| 1394088 | N/A | N/A | 5505 | 5520 | GTGTACACGAGTATAT | 108 | AD | 1471 |
| 1394090 | N/A | N/A | 5495 | 5510 | GTATATTAGGAAATTG | 127 | AD | 1472 |
| 1394091 | 83 | 98 | 3345 | 3360 | TTGTGTTGTATGAAGT | 29 | AD | 1530 |
| 1394092 | 523 | 538 | 14217 | 14232 | CAATAAGTTTTAGTCT | 79 | AD | 1474 |
| 1394093 | 93 | 108 | 3355 | 3370 | GTATAGAGTATTGTGT | 83 | AD | 244 |

TABLE 5-continued

Reduction of PLN RNA by modified oligonucleotides with a mixed cEt/2'-OMe sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1394094 | 1274 | 1289 | 14968 | 14983 | CTGAAGTCTTAAGGTT | 45 | AD | 1264 |
| 1394097 | 1525 | 1540 | 15219 | 15234 | TAAGATTTTGCGGACC | 27 | AD | 200 |
| 1394107 | 1469 | 1484 | 15163 | 15178 | AGCTGTAGATGTAATA | 62 | AD | 836 |
| 1343141 | 822 | 837 | 14516 | 14531 | TTACTTTGATACTTGG | 3 | AG | 612 |
| 1393850 | N/A | N/A | 6939 | 6954 | TTTGGACTTGTGGTAA | 57 | AG | 1520 |
| 1393851 | N/A | N/A | 6945 | 6960 | CCCTUTTTTGGACTTG | 38 | AG | 1590 |
| 1393852 | N/A | N/A | 7358 | 7373 | ATGTUGTATATGCTGA | 18 | AG | 1591 |
| 1393853 | N/A | N/A | 7356 | 7371 | GTTGUATATGCTGAGC | 57 | AG | 1592 |
| 1393854 | N/A | N/A | 3808 | 3823 | TTCAGATGTAAATAGC | 32 | AG | 1394 |
| 1393855 | N/A | N/A | 7360 | 7375 | TGATGTTGTATATGCT | 28 | AG | 1510 |
| 1393856 | N/A | N/A | 3803 | 3818 | ATGTAAATAGCTCAGT | 78 | AG | 378 |
| 1393857 | N/A | N/A | 7362 | 7377 | AATGATGTTGTATATG | 106 | AG | 1393 |
| 1393858 | N/A | N/A | 5497 | 5512 | GAGTATATTAGGAAAT | 98 | AG | 1399 |
| 1393859 | N/A | N/A | 3807 | 3822 | TCAGATGTAAATAGCT | 22 | AG | 1225 |
| 1393860 | N/A | N/A | 7361 | 7376 | ATGAUGTTGTATATGC | 50 | AG | 1593 |
| 1393861 | N/A | N/A | 3805 | 3820 | AGATGTAAATAGCTCA | 39 | AG | 1355 |
| 1393862 | N/A | N/A | 7359 | 7374 | GATGUTGTATATGCTG | 12 | AG | 1594 |
| 1393863 | N/A | N/A | 5498 | 5513 | CGAGUATATTAGGAAA | 55 | AG | 1595 |
| 1393864 | 1610 | 1625 | 15304 | 15319 | AATACATATAACACGC | 22 | AG | 426 |
| 1393865 | 1608 | 1623 | 15302 | 15317 | TACAUATAACACGCAA | 50 | AG | 1596 |
| 1393866 | N/A | N/A | 5500 | 5515 | CACGAGTATATTAGGA | 59 | AG | 675 |
| 1393867 | 1609 | 1624 | 15303 | 15318 | ATACATATAACACGCA | 13 | AG | 1397 |
| 1393868 | N/A | N/A | 5501 | 5516 | ACACGAGTATATTAGG | 18 | AG | 609 |
| 1393869 | N/A | N/A | 5499 | 5514 | ACGAGTATATTAGGAA | 55 | AG | 737 |
| 1393870 | 1611 | 1626 | 15305 | 15320 | TAATACATATAACACG | 129 | AG | 1398 |
| 1393871 | N/A | N/A | 5502 | 5517 | TACACGAGTATATTAG | 28 | AG | 538 |
| 1393873 | 1607 | 1622 | 15301 | 15316 | ACATATAACACGCAAA | 50 | AG | 54 |
| 1393874 | N/A | N/A | 5414 | 5429 | CTAAUTTGGAGAGGTA | 38 | AG | 1597 |
| 1393877 | N/A | N/A | 4233 | 4248 | AGGAUAATAACTTGAC | 58 | AG | 1598 |
| 1393883 | N/A | N/A | 5413 | 5428 | TAATUTGGAGAGGTAA | 76 | AG | 1599 |
| 1393886 | N/A | N/A | 5418 | 5433 | TTGTCTAATTTGGAGA | 83 | AG | 1481 |
| 1393887 | 645 | 660 | 14339 | 14354 | AAATUTGTGAGCCATG | 22 | AG | 1600 |
| 1393889 | N/A | N/A | 5419 | 5434 | ATTGUCTAATTTGGAG | 100 | AG | 1601 |
| 1393891 | N/A | N/A | 5417 | 5432 | TGTCUAATTTGGAGAG | 63 | AG | 1602 |
| 1393893 | 646 | 661 | 14340 | 14355 | GAAAUTTGTGAGCCAT | 8 | AG | 1603 |

TABLE 5-continued

Reduction of PLN RNA by modified oligonucleotides with a mixed cEt/2'-OMe sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393894 | 1312 | 1327 | 15006 | 15021 | ATGTUAGGCTGGAATG | 91 | AG | 1604 |
| 1393895 | N/A | V/A | 4540 | 4555 | TATTUGTAGTGAGCAA | 26 | AG | 1605 |
| 1393897 | N/A | N/A | 4542 | 4557 | CTTAUTTGTAGTGAGC | 39 | AG | 1606 |
| 1393900 | N/A | N/A | 4544 | 4559 | TTCTUATTTGTAGTGA | 56 | AG | 1607 |
| 1393901 | N/A | N/A | 4541 | 4556 | TTATUTGTAGTGAGCA | 28 | AG | 1608 |
| 1393903 | N/A | N/A | 4545 | 4560 | GTTCUTATTTGTAGTG | 50 | AG | 1609 |
| 1393908 | 1315 | 1330 | 15009 | 15024 | TGGAUGTTAGGCTGGA | 25 | AG | 1610 |
| 1393910 | N/A | N/A | 7863 | 7878 | GGTGUAGAAATGCCAG | 73 | AG | 1611 |
| 1393912 | 1313 | 1328 | 15007 | 15022 | GATGUTAGGCTGGAAT | 98 | AG | 1612 |
| 1393914 | 1529 | 1544 | 15223 | 15238 | TAGTUAAGATTTTGCG | 45 | AG | 1613 |
| 1393915 | N/A | N/A | 7865 | 7880 | TGGGUGTAGAAATGCC | 74 | AG | 1614 |
| 1393919 | 879 | 894 | 14573 | 14588 | ATAACAGATGTGAGGA | 24 | AG | 1072 |
| 1393920 | 875 | 890 | 14569 | 14584 | CAGAUGTGAGGAGTCA | 17 | AG | 1615 |
| 1393922 | 1507 | 1522 | 15201 | 15216 | CGAAUTGTCAGCTCCC | 7 | AG | 1616 |
| 1393925 | N/A | N/A | 4519 | 4534 | TTAACATTTGTCATAG | 58 | AG | 708 |
| 1393927 | N/A | N/A | 4516 | 4531 | ACATUTGTCATAGGAA | 40 | AG | 1617 |
| 1393928 | N/A | N/A | 4515 | 4530 | CATTUGTCATAGGAAT | 61 | AG | 1618 |
| 1393931 | 1533 | 1548 | 15227 | 15242 | TAGGUAGTTAAGATTT | 32 | AG | 1619 |
| 1393932 | 1530 | 1545 | 15224 | 15239 | GTAGUTAAGATTTTGC | 47 | AG | 1620 |
| 1393933 | N/A | N/A | 4517 | 4532 | AACAUTTGTCATAGGA | 22 | AG | 1621 |
| 1393934 | 87 | 102 | 3349 | 3364 | AGTAUTGTGTTGTATG | 35 | AG | 1622 |
| 1393935 | 86 | 101 | 3348 | 3363 | GTATUGTGTTGTATGA | 19 | AG | 1623 |
| 1393938 | 530 | 545 | 14224 | 14239 | ATGGUAACAATAAGTT | 48 | AG | 1624 |
| 1393940 | 89 | 104 | 3351 | 3366 | AGAGUATTGTGTTGTA | 18 | AG | 1625 |
| 1393946 | 1462 | 1477 | 15156 | 15171 | GATGUAATAGATGGGC | 62 | AG | 1626 |
| 1393949 | N/A | N/A | 5504 | 5519 | TGTACACGAGTATATT | 58 | AG | 1413 |
| 1393950 | 1464 | 1479 | 15158 | 15173 | TAGAUGTAATAGATGG | 23 | AG | 1627 |
| 1393956 | 822 | 837 | 14516 | 14531 | TTACUTTGATACTTGG | 10 | AG | 1628 |
| 1394050 | 1325 | 1340 | 15019 | 15034 | TTGCCTGCATTGGATG | 41 | AG | 1525 |
| 1394053 | 1555 | 1570 | 15249 | 15264 | TTTAUGGTCAATAGTA | 61 | AG | 1629 |
| 1394061 | N/A | N/A | 12082 | 12097 | TAAGUACTGAAGACTG | 125 | AG | 1630 |
| 1394063 | N/A | N/A | 12092 | 12107 | GATTUGATGTTAAGTA | 146 | AG | 1631 |
| 1394065 | N/A | N/A | 7279 | 7294 | TTTTUGGTGGTATTCC | 40 | AG | 1632 |
| 1394068 | N/A | N/A | 5494 | 5509 | TATAUTAGGAAATTGC | 56 | AG | 1633 |
| 1394069 | N/A | N/A | 3811 | 3826 | TAGTUCAGATGTAAAT | 132 | AG | 1634 |
| 1394070 | N/A | N/A | 6937 | 6952 | TGGACTTGTGGTAATA | 24 | AG | 1526 |

TABLE 5-continued

Reduction of PLN RNA by modified oligonucleotides with a mixed cEt/2'-OMe sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1394074 | N/A | N/A | 7354 | 7369 | TGTAUATGCTGAGCAT | 47 | AG | 1635 |
| 1394077 | N/A | N/A | 6947 | 6962 | TACCCTTTTTTGGACT | 61 | AG | 1463 |
| 1394082 | 1503 | 1518 | 15197 | 15212 | TTGTCAGCTCCCCTAA | 41 | AG | 1527 |
| 1394083 | N/A | N/A | 7857 | 7872 | GAAAUGCCAGACTCCT | 53 | AG | 1636 |
| 1394086 | N/A | N/A | 5421 | 5436 | ATATUGTCTAATTTGG | 50 | AG | 1637 |
| 1394089 | 1459 | 1474 | 15153 | 15168 | GTAAUAGATGGGCCAA | 36 | AG | 1638 |
| 1394095 | N/A | N/A | 4513 | 4528 | TTTGUCATAGGAATTG | 73 | AG | 1639 |
| 1394096 | N/A | N/A | 5506 | 5521 | TGTGUACACGAGTATA | 104 | AG | 1640 |
| 1394102 | 1240 | 1255 | 14934 | 14949 | AGTAUGGTAAGCTAGG | 27 | AG | 1641 |
| 1394105 | 1254 | 1269 | 14948 | 14963 | GATTCCAAAGATATAG | 31 | AG | 701 |
| 1343141 | 822 | 837 | 14516 | 14531 | TTACTTTGATACTTGG | 6 | AH | 612 |
| 1393344 | 1248 | 1263 | 14942 | 14957 | AAAGATATAGTATGGT | 41 | AH | 120 |
| 1393345 | 1244 | 1259 | 14938 | 14953 | ATATAGTATGGTAAGC | 70 | AH | 194 |
| 1393346 | 1243 | 1258 | 14937 | 14952 | TATAGTATGGTAAGCT | 80 | AH | 119 |
| 1393347 | 1246 | 1261 | 14940 | 14955 | AGATATAGTATGGTAA | 66 | AH | 270 |
| 1393348 | 1018 | 1033 | 14712 | 14727 | TTATGTAAGAGTATGG | 55 | AH | 262 |
| 1393349 | 1250 | 1265 | 14944 | 14959 | CCAAAGATATAGTATG | 37 | AH | 921 |
| 1393350 | 1251 | 1266 | 14945 | 14960 | TCCAAAGATATAGTAT | 27 | AH | 1423 |
| 1393774 | 558 | 573 | 14252 | 14267 | GTTTACAAGATCCAAC | 83 | AH | 33 |
| 1393775 | 560 | 575 | 14254 | 14269 | ATGTUTACAAGATCCA | 8 | AH | 1642 |
| 1393776 | 562 | 577 | 14256 | 14271 | TCATGTTTACAAGATC | 35 | AH | 1515 |
| 1393778 | 557 | 572 | 14251 | 14266 | TTTACAAGATCCAACA | 76 | AH | 1395 |
| 1393779 | 1320 | 1335 | 15014 | 15029 | TGCAUTGGATGTTAGG | 27 | AH | 1643 |
| 1393781 | 1318 | 1333 | 15012 | 15027 | CATTGGATGTTAGGCT | 46 | AH | 1450 |
| 1393782 | 1319 | 1334 | 15013 | 15028 | GCATUGGATGTTAGGC | 46 | AH | 1644 |
| 1393783 | 1317 | 1332 | 15011 | 15026 | ATTGGATGTTAGGCTG | 20 | AH | 1514 |
| 1393784 | 1561 | 1576 | 15255 | 15270 | GTAAGGTTTATGGTCA | 15 | AH | 53 |
| 1393785 | N/A | N/A | 11993 | 12008 | ATAGUAGTAGTTTCCA | 60 | AH | 1645 |
| 1393786 | 1323 | 1338 | 15017 | 15032 | GCCTGCATTGGATGTT | 81 | AH | 1517 |
| 1393787 | N/A | N/A | 11990 | 12005 | GTAGUAGTTTCCATCA | 79 | AH | 1646 |
| 1393788 | N/A | N/A | 11991 | 12006 | AGTAGTAGTTTCCATC | 84 | AH | 1422 |
| 1393789 | N/A | N/A | 11992 | 12007 | TAGTAGTAGTTTCCAT | 73 | AH | 1345 |
| 1393791 | 1559 | 1574 | 15253 | 15268 | AAGGUTTATGGTCAAT | 17 | AH | 1647 |
| 1393792 | 1321 | 1336 | 15015 | 15030 | CTGCATTGGATGTTAG | 54 | AH | 196 |
| 1393793 | 1322 | 1337 | 15016 | 15031 | CCTGCATTGGATGTTA | 69 | AH | 1516 |

TABLE 5-continued

Reduction of PLN RNA by modified oligonucleotides with a mixed cEt/2'-OMe sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393794 | 1262 | 1277 | 14956 | 14971 | GGTTUCATGATTCCAA | 50 | AH | 1648 |
| 1393795 | 622 | 637 | 14316 | 14331 | AATCAACAGTTGCATT | 67 | AH | 1518 |
| 1393796 | N/A | N/A | 11995 | 12010 | TAATAGTAGTAGTTTC | 103 | AH | 1425 |
| 1393797 | 1265 | 1280 | 14959 | 14974 | TAAGGTTTCATGATTC | 22 | AH | 615 |
| 1393798 | 1264 | 1279 | 14958 | 14973 | AAGGUTTCATGATTCC | 26 | AH | 1649 |
| 1393799 | 1266 | 1281 | 14960 | 14975 | TTAAGGTTTCATGATT | 51 | AH | 1428 |
| 1393800 | N/A | N/A | 11994 | 12009 | AATAGTAGTAGTTTCC | 58 | AH | 1166 |
| 1393801 | 623 | 638 | 14317 | 14332 | AAATCAACAGTTGCAT | 83 | AH | 1429 |
| 1393802 | 1263 | 1278 | 14957 | 14972 | AGGTUTCATGATTCCA | 33 | AH | 1650 |
| 1393803 | 1267 | 1282 | 14961 | 14976 | CTTAAGGTTTCATGAT | 50 | AH | 195 |
| 1393804 | 627 | 642 | 14321 | 14336 | GAGGAAATCAACAGTT | 22 | AH | 1430 |
| 1393806 | N/A | N/A | 7282 | 7297 | GTATUTTTGGTGGTAT | 67 | AH | 1651 |
| 1393807 | N/A | N/A | 7284 | 7299 | CAGTATTTTTGGTGGT | 14 | AH | 642 |
| 1393808 | N/A | N/A | 7286 | 7301 | TTCAGTATTTTTGGTG | 73 | AH | 1433 |
| 1393809 | 625 | 640 | 14319 | 14334 | GGAAATCAACAGTTGC | 7 | AH | 564 |
| 1393810 | 624 | 639 | 14318 | 14333 | GAAAUCAACAGTTGCA | 54 | AH | 1652 |
| 1393811 | N/A | N/A | 7287 | 7302 | CTTCAGTATTTTTGGT | 92 | AH | 1435 |
| 1393812 | N/A | N/A | 7283 | 7298 | AGTAUTTTTGGTGGTA | 33 | AH | 1653 |
| 1393813 | N/A | N/A | 7285 | 7300 | TCAGUATTTTTGGTGG | 83 | AH | 1654 |
| 1393814 | N/A | N/A | 12090 | 12105 | TTTGATGTTAAGTACT | 51 | AH | 1439 |
| 1393815 | 539 | 554 | 14233 | 14248 | TGAAUACATATGGTAA | 54 | AH | 1655 |
| 1393816 | N/A | N/A | 12089 | 12104 | TTGAUGTTAAGTACTG | 53 | AH | 1656 |
| 1393818 | N/A | N/A | 12085 | 12100 | TGTTAAGTACTGAAGA | 71 | AH | 1436 |
| 1393819 | N/A | N/A | 12086 | 12101 | ATGTUAAGTACTGAAG | 98 | AH | 1657 |
| 1393820 | 538 | 553 | 14232 | 14247 | GAATACATATGGTAAC | 72 | AH | 1386 |
| 1393821 | N/A | N/A | 12088 | 12103 | TGATGTTAAGTACTGA | 41 | AH | 1438 |
| 1393822 | N/A | N/A | 12087 | 12102 | GATGUTAAGTACTGAA | 67 | AH | 1658 |
| 1393823 | N/A | N/A | 12084 | 12099 | GTTAAGTACTGAAGAC | 84 | AH | 1125 |
| 1393824 | N/A | N/A | 7562 | 7577 | CTAAUGTCATATACCA | 34 | AH | 1659 |
| 1393825 | 1566 | 1581 | 15260 | 15275 | TATCAGTAAGGTTTAT | 54 | AH | 1445 |
| 1393826 | 541 | 556 | 14235 | 14250 | GATGAATACATATGGT | 26 | AH | 1262 |
| 1393827 | N/A | N/A | 7560 | 7575 | AATGUCATATACCATG | 85 | AH | 1660 |
| 1393828 | N/A | N/A | 7561 | 7576 | TAATGTCATATACCAT | 66 | AH | 1442 |
| 1393829 | 1565 | 1580 | 15259 | 15274 | ATCAGTAAGGTTTATG | 65 | AH | 203 |
| 1393830 | N/A | N/A | 7563 | 7578 | ACTAATGTCATATACC | 25 | AH | 1344 |
| 1393831 | N/A | N/A | 7565 | 7580 | TGACUAATGTCATATA | 86 | AH | 1661 |

TABLE 5-continued

Reduction of PLN RNA by modified oligonucleotides with a mixed cEt/2'-OMe sugar motif and uniform phosphorothioate internucleoside linkages at a concentration of 6000 nM in iCell® cardiomyocytes[2]

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393832 | N/A | N/A | 7566 | 7581 | TTGACTAATGTCATAT | 106 | AH | 1444 |
| 1393833 | N/A | N/A | 7564 | 7579 | GACTAATGTCATATAC | 89 | AH | 1244 |
| 1393835 | 1272 | 1287 | 14966 | 14981 | GAAGUCTTAAGGTTTC | 60 | AH | 1662 |
| 1393836 | N/A | N/A | 5850 | 5865 | GAATGTAATGCTATGC | 56 | AH | 732 |
| 1393837 | N/A | N/A | 5851 | 5866 | AGAAUGTAATGCTATG | 60 | AH | 1663 |
| 1393838 | N/A | N/A | 5848 | 5863 | ATGTAATGCTATGCAT | 93 | AH | 1448 |
| 1393839 | 1271 | 1286 | 14965 | 14980 | AAGTCTTAAGGTTTCA | 30 | AH | 1446 |
| 1393840 | 1269 | 1284 | 14963 | 14978 | GTCTUAAGGTTTCATG | 83 | AH | 1664 |
| 1393841 | 1268 | 1283 | 14962 | 14977 | TCTTAAGGTTTCATGA | 72 | AH | 533 |
| 1393842 | 1270 | 1285 | 14964 | 14979 | AGTCUTAAGGTTTCAT | 67 | AH | 1665 |
| 1393843 | N/A | N/A | 5847 | 5862 | TGTAATGCTATGCATA | 40 | AH | 1447 |
| 1393844 | N/A | N/A | 6943 | 6958 | CTTTUTTGGACTTGTG | 56 | AH | 1666 |
| 1393845 | N/A | N/A | 6944 | 6959 | CCTTUTTTGGACTTGT | 52 | AH | 1667 |
| 1393846 | N/A | N/A | 6942 | 6957 | TTTTUTGGACTTGTGG | 64 | AH | 1668 |
| 1393847 | N/A | N/A | 6940 | 6955 | TTTTGGACTTGTGGTA | 72 | AH | 1522 |
| 1393848 | N/A | N/A | 6941 | 6956 | TTTTUGGACTTGTGGT | 79 | AH | 1669 |
| 1393849 | N/A | N/A | 7357 | 7372 | TGTTGTATATGCTGAG | 33 | AH | 1521 |

Example 6: Effect of Mixed Sugar Motif, Uniform Phosphorothioate Modified Oligonucleotides on Human PLN RNA In Vitro, Single Dose Modified oligonucleotides complementary to human PLN nucleic acid were designed and tested for their single dose effects on PLN RNA in vitro. The modified oligonucleotides were tested in a series of experiments that had the same culture conditions.

"Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the tables below is 100% complementary to SEQ ID NO: 1 (described herein above), to SEQ TD NO: 2 (described herein above), or to both. "N/A" indicates that the modified oligonucleotide is not 100% complementary to that particular target nucleic acid sequence.

Cultured iCell® cardiomyocytes[2] (FujiFilm Cellular Dynamics, Inc.; Catalog No: R1017) were treated with modified oligonucleotide at a concentration of 4000 nM by free uptake at a density of 8,000 cells per well. After a treatment period of approximately 72 hours, total RNA was isolated from the cells and PLN RNA levels were measured by quantitative real-time RTPCR. PLN RNA levels were measured by human primer-probe set RTS40402 (described herein above). PLN RNA levels were normalized to total RNA content, as measured by RIBOGREEN® Reduction of PLN RNA is presented in the tables below as percent PLN RNA relative to the amount in untreated control cells (% UTC).

Each separate experimental analysis described in this example is identified by a letter ID in the table columns below labeled "AID" (Analysis ID).

The modified oligonucleotides in the table below are 3-10-3 cEt modified oligonucleotides with uniform phosphorothioate internucleoside linkages. The modified oligonucleotides are 16 nucleosides in length, wherein the central gap segment consists of ten 2'-β-D-deoxynucleosides, and wherein the 5' and 3' wing segments each consist of three cEt nucleosides. The sugar motif for the modified oligonucleotides is (from 5' to 3'): kkkddddddddddkkk; wherein each "d" represents a 2'-β-D-deoxyribosyl sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

TABLE 6

Reduction of PLN RNA by 3-10-3 cEt modified oligonucleotides with uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1121440 | 1246 | 1261 | 14940 | 14955 | AGATATAGTATGGTAA | 34 | AI | 270 |
| 1342309 | 1249 | 1264 | 14943 | 14958 | CAAAGATATAGTATGG | 26 | AI | 942 |
| 1342911 | 1530 | 1545 | 15224 | 15239 | GTAGTTAAGATTTTGC | 24 | AI | 752 |
| 1342944 | N/A | N/A | 5500 | 5515 | CACGAGTATATTAGGA | 23 | AI | 675 |
| 1343056 | 1250 | 1265 | 14944 | 14959 | CCAAAGATATAGTATG | 38 | AI | 921 |
| 1393402 | 1251 | 1266 | 14945 | 14960 | TCCAAAGATATAGTAT | 44 | AI | 1423 |
| 1121400 | 823 | 838 | 14517 | 14532 | ATTACTTTGATACTTG | 25 | AJ | 260 |
| 1121403 | 992 | 1007 | 14686 | 14701 | CCATACTTGATTCTCA | 33 | AJ | 185 |
| 1121441 | 1247 | 1262 | 14941 | 14956 | AAGATATAGTATGGTA | 21 | AJ | 45 |
| 1121442 | 1248 | 1263 | 14942 | 14957 | AAAGATATAGTATGGT | 24 | AJ | 120 |
| 1343077 | N/A | N/A | 5501 | 5516 | ACACGAGTATATTAGG | 15 | AJ | 609 |

The modified oligonucleotides in the table below are 16 nucleosides in length, wherein the sugar motif for the modified oligonucleotides is (from 5' to 3'): kkddddddddd-kekek; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

TABLE 7

Reduction of PLN RNA by modified oligonucleotides with a mixed MOE/cEt sugar motif and uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1343467 | 1249 | 1264 | 14943 | 14958 | CAAAGATATAGTATGG | 16 | AI | 942 |
| 1393581 | 1248 | 1263 | 14942 | 14957 | AAAGATATAGTATGGT | 18 | AI | 120 |
| 1343467 | 1249 | 1264 | 14943 | 14958 | CAAAGATATAGTATGG | 21 | AJ | 942 |
| 1343475 | 1247 | 1262 | 14941 | 14956 | AAGATATAGTATGGTA | 17 | AJ | 45 |
| 1393575 | 1246 | 1261 | 14940 | 14955 | AGATATAGTATGGTAA | 18 | AJ | 270 |

The modified oligonucleotides in the table below are 16 nucleosides in length, wherein the sugar motif for the modified oligonucleotides is (from 5' to 3'): kkkdddddddddkkke; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

TABLE 8

Reduction of PLN RNA by modified oligonucleotides with a mixed MOE/cEt sugar motif and uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1393675 | N/A | N/A | 5500 | 5515 | CACGAGTATATTAGGA | 19 | AI | 675 |
| 1343648 | 1247 | 1262 | 14941 | 14956 | AAGATATAGTATGGTA | 10 | AJ | 45 |
| 1393772 | 1248 | 1263 | 14942 | 14957 | AAAGATATAGTATGGT | 14 | AJ | 120 |

The modified oligonucleotides in the table below are 2-10-2 cEt modified oligonucleotides with uniform phosphorothioate internucleoside linkages. The modified oligonucleotides are 14 nucleosides in length, wherein the central gap segment consists of ten 2'-β-D-deoxynucleosides, and wherein the 5' and 3' wing segments consist of three cEt nucleosides and four cEt nucleosides respectively. The sugar motif for the modified oligonucleotides is (from 5' to 3'): kkddddddddddkk; wherein each "d" represents a 2'-β-D-deoxyribosyl sugar moiety, and each "k" represents a cEt modified sugar moiety. The internucleoside linkage motif for the modified oligonucleotides is (from 5' to 3'): sssssssssssss; wherein each "s" represents a phosphorothioate internucleoside linkage. Each cytosine residue is a 5-methyl cytosine.

TABLE 9

Reduction of PLN RNA by 2-10-2 cEt modified oligonucleotides with uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528618 | 1531 | 1544 | 15225 | 15238 | TAGTTAAGATTTTG | 77 | AI | 1670 |
| 1528619 | N/A | N/A | 5501 | 5514 | ACGAGTATATTAGG | 29 | AI | 1671 |
| 1528621 | 1247 | 1260 | 14941 | 14954 | GATATAGTATGGTA | 56 | AI | 1672 |
| 1528624 | 1250 | 1263 | 14944 | 14957 | AAAGATATAGTATG | 71 | AI | 1673 |
| 1528820 | 1251 | 1264 | 14945 | 14958 | CAAAGATATAGTAT | 63 | AI | 1674 |
| 1528821 | 1252 | 1265 | 14946 | 14959 | CCAAAGATATAGTA | 76 | AI | 1675 |
| 1528616 | 824 | 837 | 14518 | 14531 | TTACTTTGATACTT | 56 | AJ | 1676 |
| 1528617 | 993 | 1006 | 14687 | 14700 | CATACTTGATTCTC | 58 | AJ | 1677 |
| 1528620 | N/A | N/A | 5502 | 5515 | CACGAGTATATTAG | 60 | AJ | 1678 |
| 1528622 | 1248 | 1261 | 14942 | 14955 | AGATATAGTATGGT | 52 | AJ | 1679 |
| 1528623 | 1249 | 1262 | 14943 | 14956 | AAGATATAGTATGG | 50 | AJ | 1680 |

The modified oligonucleotides in the table below are 17 nucleosides in length, wherein the sugar motif for the modified oligonucleotides is (from 5' to 3'): kkkddddddddddkeee; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): ssssssssssssssss; wherein each "s" represents a phosphorothioate internucleoside linkage. Each cytosine residue is a 5-methyl cytosine.

TABLE 10

Reduction of PLN RNA by modified oligonucleotides with a mixed MOE/cEt sugar motif and uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528661 | 1529 | 1545 | 15223 | 15239 | GTAGTTAAGATTTTGCG | 21 | AI | 1670 |
| 1528662 | N/A | N/A | 5499 | 5515 | CACGAGTATATTAGGAA | 18 | AI | 1671 |
| 1528664 | 1245 | 1261 | 14939 | 14955 | AGATATAGTATGGTAAG | 36 | AI | 1672 |
| 1528667 | 1248 | 1264 | 14942 | 14958 | CAAAGATATAGTATGGT | 29 | AI | 1673 |
| 1528830 | 1249 | 1265 | 14943 | 14959 | CCAAAGATATAGTATGG | 36 | AI | 1674 |
| 1528831 | 1250 | 1266 | 14944 | 14960 | TCCAAAGATATAGTATG | 51 | AI | 1675 |
| 1528655 | 822 | 838 | 14516 | 14532 | ATTACTTTGATACTTGG | 33 | AJ | 1676 |
| 1528658 | 991 | 1007 | 14685 | 14701 | CCATACTTGATTCTCAT | 41 | AJ | 1677 |
| 1528663 | N/A | N/A | 5500 | 5516 | ACACGAGTATATTAGGA | 21 | AJ | 1678 |
| 1528665 | 1246 | 1262 | 14940 | 14956 | AAGATATAGTATGGTAA | 39 | AJ | 1679 |
| 1528666 | 1247 | 1263 | 14941 | 14957 | AAAGATATAGTATGGTA | 42 | AJ | 1680 |

The modified oligonucleotides in the table below are 17 nucleosides in length, wherein the sugar motif for the modified oligonucleotides is (from 5' to 3'): kkkddddddddddkkee; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): ssssssssssssssss; wherein each "s" represents a phosphorothioate internucleoside linkage. Each cytosine residue is a 5-methyl cytosine.

TABLE 11

Reduction of PLN RNA by modified oligonucleotides with a mixed MOE/cEt sugar motif and uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528648 | 1529 | 1545 | 15223 | 15239 | GTAGTTAAGATTTTGCG | 25 | AI | 1670 |
| 1528649 | N/A | N/A | 5499 | 5515 | CACGAGTATATTAGGAA | 19 | AI | 1671 |
| 1528651 | 1245 | 1261 | 14939 | 14955 | AGATATAGTATGGTAAG | 26 | AI | 1672 |
| 1528654 | 1248 | 1264 | 14942 | 14958 | CAAAGATATAGTATGGT | 16 | AI | 1673 |
| 1528826 | 1249 | 1265 | 14943 | 14959 | CCAAAGATATAGTATGG | 42 | AI | 1674 |
| 1528827 | 1250 | 1266 | 14944 | 14960 | TCCAAAGATATAGTATG | 40 | AI | 1675 |
| 1528646 | 822 | 838 | 14516 | 14532 | ATTACTTTGATACTTGG | 21 | AJ | 1676 |
| 1528647 | 991 | 1007 | 14685 | 14701 | CCATACTTGATTCTCAT | 39 | AJ | 1677 |
| 1528650 | N/A | N/A | 5500 | 5516 | ACACGAGTATATTAGGA | 20 | AJ | 1678 |
| 1528652 | 1246 | 1262 | 14940 | 14956 | AAGATATAGTATGGTAA | 27 | AJ | 1679 |
| 1528653 | 1247 | 1263 | 14941 | 14957 | AAAGATATAGTATGGTA | 29 | AJ | 1680 |

The modified oligonucleotides in the table below are 3-10-4 cEt modified oligonucleotides with uniform phosphorothioate internucleoside linkages. The modified oligonucleotides are 17 nucleosides in length, wherein the central gap segment consists of ten 2'-β-D-deoxynucleosides, and wherein the 5' and 3' wing segments consist of three cEt nucleosides and four cEt nucleosides respectively. The sugar motif for the modified oligonucleotides is (from 5' to 3'): kkkddddddddddkkkk; wherein each "d" represents a 2'-β-D-deoxyribosyl sugar moiety, and each "k" represents a cEt modified sugar moiety. The internucleoside linkage motif for the modified oligonucleotides is (from 5' to 3'): ssssssssssssssss; wherein each "s" represents a phosphorothioate internucleoside linkage. Each cytosine residue is a 5-methyl cytosine.

TABLE 12

Reduction of PLN RNA by 3-10-4 cEt modified oligonucleotides with uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528628 | 1529 | 1545 | 15223 | 15239 | GTAGTTAAGATTTTGCG | 36 | AI | 1670 |
| 1528629 | N/A | N/A | 5499 | 5515 | CACGAGTATATTAGGAA | 18 | AI | 1671 |
| 1528631 | 1245 | 1261 | 14939 | 14955 | AGATATAGTATGGTAAG | 20 | AI | 1672 |
| 1528634 | 1248 | 1264 | 14942 | 14958 | CAAAGATATAGTATGGT | 15 | AI | 1673 |
| 1528822 | 1249 | 1265 | 14943 | 14959 | CCAAAGATATAGTATGG | 55 | AI | 1674 |
| 1528823 | 1250 | 1266 | 14944 | 14960 | TCCAAAGATATAGTATG | 38 | AI | 1675 |
| 1528625 | 822 | 838 | 14516 | 14532 | ATTACTTTGATACTTGG | 13 | AJ | 1676 |
| 1528627 | 991 | 1007 | 14685 | 14701 | CCATACTTGATTCTCAT | 43 | AJ | 1677 |
| 1528630 | N/A | N/A | 5500 | 5516 | ACACGAGTATATTAGGA | 13 | AJ | 1678 |
| 1528632 | 1246 | 1262 | 14940 | 14956 | AAGATATAGTATGGTAA | 20 | AJ | 1679 |
| 1528633 | 1247 | 1263 | 14941 | 14957 | AAAGATATAGTATGGTA | 16 | AJ | 1680 |

The modified oligonucleotides in the table below are 4-10-3 cEt modified oligonucleotides with uniform phosphorothioate internucleoside linkages. The modified oligonucleotides are 17 nucleosides in length, wherein the central gap segment consists of ten 2'-β-D-deoxynucleosides, and wherein the 5' and 3' wing segments consist of four cEt nucleosides and three cEt nucleosides respectively. The sugar motif for the modified oligonucleotides is (from 5' to 3'): kkkkddddddddddkkk; wherein each "d" represents a 2'-β-D-deoxyribosyl sugar moiety, and each "k" represents a cEt modified sugar moiety. The internucleoside linkage motif for the modified oligonucleotides is (from 5' to 3'): ssssssssssssssss; wherein each "s" represents a phosphorothioate internucleoside linkage. Each cytosine residue is a 5-methyl cytosine.

TABLE 13

Reduction of PLN RNA by 4-10-3 cEt modified oligonucleotides with uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528637 | 1530 | 1546 | 15224 | 15240 | GGTAGTTAAGATTTTGC | 25 | AI | 1681 |
| 1528639 | N/A | N/A | 5500 | 5516 | ACACGAGTATATTAGGA | 19 | AI | 1678 |

TABLE 13-continued

Reduction of PLN RNA by 4-10-3 cEt modified oligonucleotides with uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528642 | 1246 | 1262 | 14940 | 14956 | AAGATATAGTATGGTAA | 27 | AI | 1679 |
| 1528645 | 1249 | 1265 | 14943 | 14959 | CCAAAGATATAGTATGG | 63 | AI | 1674 |
| 1528824 | 1250 | 1266 | 14944 | 14960 | TCCAAAGATATAGTATG | 34 | AI | 1675 |
| 1528825 | 1251 | 1267 | 14945 | 14961 | TTCCAAAGATATAGTAT | 49 | AI | 1682 |
| 1528635 | 823 | 839 | 14517 | 14533 | TATTACTTTGATACTTG | 32 | AJ | 1683 |
| 1528636 | 992 | 1008 | 14686 | 14702 | TCCATACTTGATTCTCA | 41 | AJ | 1684 |
| 1528640 | N/A | N/A | 5501 | 5517 | TACACGAGTATATTAGG | 26 | AJ | 1685 |
| 1528643 | 1247 | 1263 | 14941 | 14957 | AAAGATATAGTATGGTA | 18 | AJ | 1680 |
| 1528644 | 1248 | 1264 | 14942 | 14958 | CAAAGATATAGTATGGT | 18 | AJ | 1673 |

The modified oligonucleotides in the table below are 18 nucleosides in length, wherein the sugar motif for the modified oligonucleotides is (from 5' to 3'): kkkddddddddddkeeee; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssssss; wherein each "s" represents a phosphorothioate internucleoside linkage. Each cytosine residue is a 5-methyl cytosine.

TABLE 14

Reduction of PLN RNA by modified oligonucleotides with a mixed MOE/cEt sugar motif and uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528603 | 1244 | 1261 | 14938 | 14955 | AGATATAGTATGGTAAGC | 30 | AI | 1686 |
| 1528606 | 1247 | 1264 | 14941 | 14958 | CAAAGATATAGTATGGTA | 31 | AI | 1687 |
| 1528680 | 1528 | 1545 | 15222 | 15239 | GTAGTTAAGATTTTGCGG | 32 | AI | 1688 |
| 1528682 | N/A | N/A | 5498 | 5515 | CACGAGTATATTAGGAAA | 17 | AI | 1689 |
| 1528816 | 1248 | 1265 | 14942 | 14959 | CCAAAGATATAGTATGGT | 28 | AI | 1690 |
| 1528817 | 1249 | 1266 | 14943 | 14960 | TCCAAAGATATAGTATGG | 31 | AI | 1691 |
| 1528604 | 1245 | 1262 | 14939 | 14956 | AAGATATAGTATGGTAAG | 24 | AJ | 1692 |
| 1528605 | 1246 | 1263 | 14940 | 14957 | AAAGATATAGTATGGTAA | 24 | AJ | 1693 |
| 1528678 | 821 | 838 | 14515 | 14532 | ATTACTTTGATACTTGGT | 29 | AJ | 1694 |
| 1528679 | 990 | 1007 | 14684 | 14701 | CCATACTTGATTCTCATC | 48 | AJ | 1695 |
| 1528683 | N/A | N/A | 5499 | 5516 | ACACGAGTATATTAGGAA | 30 | AJ | 1696 |

The modified oligonucleotides in the table below are 18 nucleosides in length, wherein the sugar motif for the modified oligonucleotides is (from 5' to 3'): kkkddddddddddkkeee; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssssss; wherein each "s" represents a phosphorothioate internucleoside linkage. Each cytosine residue is a 5-methyl cytosine.

TABLE 15

Reduction of PLN RNA by modified oligonucleotides with a mixed MOE/cEt sugar motif and uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528670 | 1528 | 1545 | 15222 | 15239 | GTAGTTAAGATTTTGCGG | 71 | AI | 1688 |
| 1528671 | N/A | N/A | 5498 | 5515 | CACGAGTATATTAGGAAA | 13 | AI | 1689 |
| 1528674 | 1244 | 1261 | 14938 | 14955 | AGATATAGTATGGTAAGC | 20 | AI | 1686 |
| 1528677 | 1247 | 1264 | 14941 | 14958 | CAAAGATATAGTATGGTA | 18 | AI | 1687 |
| 1528832 | 1248 | 1265 | 14942 | 14959 | CCAAAGATATAGTATGGT | 44 | AI | 1690 |
| 1528833 | 1249 | 1266 | 14943 | 14960 | TCCAAAGATATAGTATGG | 35 | AI | 1691 |
| 1528668 | 821 | 838 | 14515 | 14532 | ATTACTTTGATACTTGGT | 24 | AJ | 1694 |
| 1528669 | 990 | 1007 | 14684 | 14701 | CCATACTTGATTCTCATC | 38 | AJ | 1695 |
| 1528672 | N/A | N/A | 5499 | 5516 | ACACGAGTATATTAGGAA | 25 | AJ | 1696 |
| 1528675 | 1245 | 1262 | 14939 | 14956 | AAGATATAGTATGGTAAG | 31 | AJ | 1692 |
| 1528676 | 1246 | 1263 | 14940 | 14957 | AAAGATATAGTATGGTAA | 29 | AJ | 1693 |

The modified oligonucleotides in the table below are 4-10-4 cEt modified oligonucleotides with uniform phosphorothioate internucleoside linkages. The modified oligonucleotides are 18 nucleosides in length, wherein the central gap segment consists of ten 2'-β-D-deoxynucleosides, and wherein the 5' and 3' wing segments each consist of four cEt nucleosides. The sugar motif for the modified oligonucleotides is (from 5' to 3'): kkkkddddddddddkkkk; wherein each "d" represents a 2'-β-D-deoxyribosyl sugar moiety, and each "k" represents a cEt modified sugar moiety. The internucleoside linkage motif for the modified oligonucleotides is (from 5' to 3'): sssssssssssssssss; wherein each "s" represents a phosphorothioate internucleoside linkage. Each cytosine residue is a 5-methyl cytosine.

TABLE 16

Reduction of PLN RNA by 4-10-4 cEt modified oligonucleotides with uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528608 | 1529 | 1546 | 15223 | 15240 | GGTAGTTAAGATTTTGCG | 45 | AI | 1697 |
| 1528609 | N/A | N/A | 5499 | 5516 | ACACGAGTATATTAGGAA | 20 | AI | 1696 |
| 1528611 | 1245 | 1262 | 14939 | 14956 | AAGATATAGTATGGTAAG | 61 | AI | 1692 |
| 1528614 | 1248 | 1265 | 14942 | 14959 | CCAAAGATATAGTATGGT | 53 | AI | 1690 |
| 1528818 | 1249 | 1266 | 14943 | 14960 | TCCAAAGATATAGTATGG | 54 | AI | 1691 |

TABLE 16-continued

Reduction of PLN RNA by 4-10-4 cEt modified oligonucleotides with uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528819 | 1250 | 1267 | 14944 | 14961 | TTCCAAAGATATAGTATG | 38 | AI | 1698 |
| 1528607 | 991 | 1008 | 14685 | 14702 | TCCATACTTGATTCTCAT | 35 | AJ | 1699 |
| 1528610 | N/A | N/A | 5500 | 5517 | TACACGAGTATATTAGGA | 22 | AJ | 1700 |
| 1528612 | 1246 | 1263 | 14940 | 14957 | AAAGATATAGTATGGTAA | 20 | AJ | 1693 |
| 1528613 | 1247 | 1264 | 14941 | 14958 | CAAAGATATAGTATGGTA | 18 | AJ | 1687 |
| 1528681 | 822 | 839 | 14516 | 14533 | TATTACTTTGATACTTGG | 20 | AJ | 1701 |

The modified oligonucleotides in the table below are 5-10-5 cEt modified oligonucleotides with uniform phosphorothioate internucleoside linkages. The modified oligonucleotides are 20 nucleosides in length, wherein the central gap segment consists of ten 2'-β-D-deoxynucleosides, and wherein the 5' and 3' wing segments each consist of five cEt nucleosides. The sugar motif for the modified oligonucleotides is (from 5' to 3'): kkkkkddddddddddkkkkk; wherein each "d" represents a 2'-β-D-deoxyribosyl sugar moiety, and each "k" represents a cEt modified sugar moiety.

The internucleoside linkage motif for the modified oligonucleotides is (from 5' to 3'): sssssssssssssssssss; wherein each "s" represents a phosphorothioate internucleoside linkage. Each cytosine residue is a 5-methyl cytosine.

TABLE 17

Reduction of PLN RNA by 5-10-5 cEt modified oligonucleotides with uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528626 | 1528 | 1547 | 15222 | 15241 | AGGTAGTTAAGATTTTGCGG | 49 | AI | 1702 |
| 1528638 | N/A | N/A | 5498 | 5517 | TACACGAGTATATTAGGAAA | 26 | AI | 1703 |
| 1528656 | 1244 | 1263 | 14938 | 14957 | AAAGATATAGTATGGTAAGC | 30 | AI | 1704 |
| 1528660 | 1247 | 1266 | 14941 | 14960 | TCCAAAGATATAGTATGGTA | 48 | AI | 1705 |
| 1528828 | 1248 | 1267 | 14942 | 14961 | TTCCAAAGATATAGTATGGT | 46 | AI | 1706 |
| 1528829 | 1249 | 1268 | 14943 | 14962 | ATTCCAAAGATATAGTATGG | 73 | AI | 1707 |
| 1528615 | 990 | 1009 | 14684 | 14703 | TTCCATACTTGATTCTCATC | 39 | AJ | 1708 |
| 1528641 | N/A | N/A | 5499 | 5518 | GTACACGAGTATATTAGGAA | 48 | AJ | 1709 |
| 1528657 | 1245 | 1264 | 14939 | 14958 | CAAAGATATAGTATGGTAAG | 33 | AJ | 1710 |
| 1528659 | 1246 | 1265 | 14940 | 14959 | CCAAAGATATAGTATGGTAA | 38 | AJ | 1711 |
| 1528673 | 821 | 840 | 14515 | 14534 | TTATTACTTTGATACTTGGT | 34 | AJ | 1712 |

The modified oligonucleotides in the table below are 16 nucleosides in length, wherein the sugar motif for the modified oligonucleotides is (from 5' to 3'): ekddddddddd-kekek; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

TABLE 18

Reduction of PLN RNA by modified oligonucleotides with a mixed MOE/cEt sugar motif and uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528840 | 1248 | 1263 | 14942 | 14957 | AAAGATATAGTATGGT | 30 | AI | 120 |
| 1528841 | 1249 | 1264 | 14943 | 14958 | CAAAGATATAGTATGG | 22 | AI | 942 |
| 1528838 | 1247 | 1262 | 14941 | 14956 | AAGATATAGTATGGTA | 26 | AJ | 45 |
| 1528839 | 1246 | 1261 | 14940 | 14955 | AGATATAGTATGGTAA | 35 | AJ | 270 |

The modified oligonucleotides in the table below are 16 nucleosides in length, wherein the sugar motif for the modified oligonucleotides is (from 5' to 3'): ekkddddddddddkkk; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

TABLE 19

Reduction of PLN RNA by modified oligonucleotides with a mixed MOE/cEt sugar motif and uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528843 | 1530 | 1545 | 15224 | 15239 | GTAGTTAAGATTTTGC | 37 | AI | 752 |
| 1528842 | N/A | N/A | 5501 | 5516 | ACACGAGTATATTAGG | 19 | AJ | 609 |
| 1528844 | 992 | 1007 | 14686 | 14701 | CCATACTTGATTCTCA | 47 | AJ | 185 |
| 1528845 | 823 | 838 | 14517 | 14532 | ATTACTTTGATACTTG | 63 | AJ | 260 |

The modified oligonucleotides in the table below are 16 nucleosides in length, wherein the sugar motif for the modified oligonucleotides is (from 5' to 3'): ekkddddddddkkke; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

TABLE 20

| Reduction of PLN RNA by modified oligonucleotides with a mixed MOE/cEt sugar motif and uniform phosphorothioate internucleoside linkages at a concentration of 4000 nM in iCell® cardiomyocytes2 | | | | | | | | |
|---|---|---|---|---|---|---|---|---|
| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
| 1528855 | N/A | N/A | 5500 | 5515 | CACGAGTATATTAGGA | 18 | AI | 675 |
| 1528854 | 1247 | 1262 | 14941 | 14956 | AAGATATAGTATGGTA | 22 | AJ | 45 |
| 1528856 | 1248 | 1263 | 14942 | 14957 | AAAGATATAGTATGGT | 28 | AJ | 120 |

The modified oligonucleotides in the table below are 16 nucleosides in length, wherein the sugar motif for the modified oligonucleotides is (from 5' to 3'): keddddddddd-kekek; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

TABLE 21

| Reduction of PLN RNA by modified oligonucleotides with a mixed MOE/cEt sugar motif and uniform phosphorothioate internucleoside linkages at a concentration of 4000 nM in iCell® cardiomyocytes2 | | | | | | | | |
|---|---|---|---|---|---|---|---|---|
| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
| 1528836 | 1248 | 1263 | 14942 | 14957 | AAAGATATAGTATGGT | 36 | AI | 120 |
| 1528837 | 1249 | 1264 | 14943 | 14958 | CAAAGATATAGTATGG | 41 | AI | 942 |
| 1528834 | 1247 | 1262 | 14941 | 14956 | AAGATATAGTATGGTA | 31 | AJ | 45 |
| 1528835 | 1246 | 1261 | 14940 | 14955 | AGATATAGTATGGTAA | 37 | AJ | 270 |

The modified oligonucleotides in the table below are 16 nucleosides in length, wherein the sugar motif for the modified oligonucleotides is (from 5' to 3'): kekddddddddddkkk; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

TABLE 22

| Reduction of PLN RNA by modified oligonucleotides with a mixed MOE/cEt sugar motif and uniform phosphorothioate internucleoside linkages at a concentration of 4000 nM in iCell® cardiomyocytes2 | | | | | | | | |
|---|---|---|---|---|---|---|---|---|
| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
| 1528847 | 1530 | 1545 | 15224 | 15239 | GTAGTTAAGATTTTGC | 39 | AI | 752 |
| 1528846 | N/A | N/A | 5501 | 5516 | ACACGAGTATATTAGG | 29 | AJ | 609 |
| 1528848 | 992 | 1007 | 14686 | 14701 | CCATACTTGATTCTCA | 51 | AJ | 185 |
| 1528849 | 823 | 838 | 14517 | 14532 | ATTACTTTGATACTTG | 37 | AJ | 260 |

The modified oligonucleotides in the table below are 16 nucleosides in length, wherein the sugar motif for the modified oligonucleotides is (from 5' to 3'): kekddddddddddkkke; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

TABLE 23

Reduction of PLN RNA by modified oligonucleotides with a mixed MOE/cEt sugar motif and uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528858 | N/A | N/A | 5500 | 5515 | CACGAGTATATTAGGA | 18 | AI | 675 |
| 1528857 | 1247 | 1262 | 14941 | 14956 | AAGATATAGTATGGTA | 24 | AJ | 45 |
| 1528859 | 1248 | 1263 | 14942 | 14957 | AAAGATATAGTATGGT | 33 | AJ | 120 |

The modified oligonucleotides in the table below are 16 nucleosides in length, wherein the sugar motif for the modified oligonucleotides is (from 5' to 3'): kkeddddddddddkkk; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

TABLE 24

Reduction of PLN RNA by modified oligonucleotides with a mixed MOE/cEt sugar motif and uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528851 | 1530 | 1545 | 15224 | 15239 | GTAGTTAAGATTTTGC | 55 | AI | 752 |
| 1528850 | N/A | N/A | 5501 | 5516 | ACACGAGTATATTAGG | 26 | AJ | 609 |
| 1528852 | 992 | 1007 | 14686 | 14701 | CCATACTTGATTCTCA | 48 | AJ | 185 |
| 1528853 | 823 | 838 | 14517 | 14532 | ATTACTTTGATACTTG | 54 | AJ | 260 |
| 1528862 | 1248 | 1263 | 14942 | 14957 | AAAGATATAGTATGGT | 44 | AJ | 120 |

The modified oligonucleotides in the table below are 16 nucleosides in length, wherein the sugar motif for the modified oligonucleotides is (from 5' to 3'): kkedddddddddkkke; wherein each "d" represents a 2'-β-D-deoxyribosyl sugar moiety, each "e" represents a 2'-MOE sugar moiety, and each "k" represents a cEt modified sugar moiety. The internucleoside linkage motif for the modified oligonucleotides is (from 5' to 3'): sssssssssssssss; wherein each "s" represents a phosphorothioate internucleoside linkage. Each cytosine residue is a 5-methyl cytosine.

TABLE 25

Reduction of PLN RNA by modified oligonucleotides with a mixed MOE/cEt sugar motif and uniform phosphorothioate internucleoside linkages at a concentration of 4000 nM in iCell® cardiomyocytes2

| Compound Number | SEQ ID No: 1 Start Site | SEQ ID No: 1 Stop Site | SEQ ID No: 2 Start Site | SEQ ID No: 2 Stop Site | Sequence (5' to 3') | PLN (% UTC) | AID | SEQ ID NO |
|---|---|---|---|---|---|---|---|---|
| 1528864 | N/A | N/A | 5500 | 5515 | CACGAGTATATTAGGA | 25 | AI | 675 |
| 1528863 | 1247 | 1262 | 14941 | 14956 | AAGATATAGTATGGTA | 30 | AJ | 45 |

Example 7: Dose-Dependent Inhibition of Human PLN in iCell® Cardiomyocytes² by Modified Oligonucleotides Modified oligonucleotides selected from the examples above were tested at various doses in iCell® cardiomyocytes² (FujiFilm Cellular Dynamics, Inc.; Catalog No: R1017). Cultured iCell® cardiomyocytes² at a density of 20,000 cells per well were treated by electroporation with various concentrations of modified oligonucleotide as specified in the tables below. After a treatment period of approximately 24 hours, total RNA was isolated from the cells, and PLN RNA levels were measured by quantitative real-time RTPCR. Human PLN primer-probe set RTS40402 (described herein above) was used to measure RNA levels as described above. PLN RNA levels were normalized to total RNA content, as measured by RIBOGREEN®. Reduction of PLN RNA is presented in the tables below as percent PLN RNA, relative to untreated control cells (% UTC).

The half maximal inhibitory concentration ($IC_{50}$) of each modified oligonucleotide was calculated using a linear regression on a log/linear plot of the data in Excel and is also presented in the tables below.

TABLE 26

Dose-dependent reduction of human PLN RNA in iCell ® cardiomyocytes² by modified oligonucleotides

| Compound | PLN RNA (% UTC) | | | | $IC_{50}$ |
|---|---|---|---|---|---|
| No. | 741 nM | 2222 nM | 6667 nM | 20000 nM | (μM) |
| 1121334 | 52 | 58 | 17 | 5 | 1.36 |
| 1121366 | 77 | 42 | 11 | 2 | 1.87 |
| 1121373 | 79 | 49 | 20 | 9 | 2.35 |
| 1121374 | 60 | 60 | 18 | 3 | 1.80 |
| 1121376 | 93 | 44 | 15 | 4 | 2.55 |
| 1121385 | 93 | 66 | 22 | 6 | 3.44 |
| 1121391 | 92 | 58 | 22 | 3 | 3.07 |
| 1121396 | 87 | 40 | 16 | 8 | 2.30 |
| 1121400 | 37 | 53 | 14 | 6 | <0.7 |
| 1121403 | 91 | 59 | 20 | 7 | 3.08 |
| 1121407 | 49 | 74 | 19 | 9 | <0.7 |
| 1121415 | 66 | 41 | 9 | 3 | 1.41 |
| 1121416 | 86 | 47 | 10 | 7 | 2.35 |
| 1121455 | 69 | 23 | 9 | 4 | 1.10 |
| 1121472 | 50 | 26 | 10 | 6 | <0.7 |
| 1121507 | 63 | 47 | 30 | 16 | 1.79 |
| 1121556 | 70 | 46 | 15 | 7 | 1.79 |
| 1121559 | 39 | 51 | 19 | 15 | <0.7 |
| 1121576 | 86 | 63 | 39 | 9 | 3.76 |

TABLE 27

Dose-dependent reduction of human PLN RNA in iCell ® cardiomyocytes² by modified oligonucleotides

| Compound | PLN RNA (% UTC) | | | | $IC_{50}$ |
|---|---|---|---|---|---|
| No. | 741 nM | 2222 nM | 6667 nM | 20000 nM | (μM) |
| 1091599 | 65 | 37 | 25 | 35 | 1.34 |
| 1121390 | 71 | 50 | 15 | 2 | 1.89 |
| 1121391 | 100 | 51 | 28 | 38 | 4.75 |
| 1121397 | 67 | 32 | 22 | 4 | 1.35 |
| 1121401 | 91 | 49 | 18 | 10 | 2.78 |
| 1121402 | 73 | 61 | 19 | 20 | 2.67 |
| 1121405 | 95 | 54 | 17 | 6 | 3.02 |
| 1121410 | 87 | 63 | 33 | 9 | 3.52 |
| 1121417 | 71 | 34 | 10 | 6 | 1.45 |
| 1121441 | 102 | 57 | 11 | 9 | 3.23 |
| 1121457 | 107 | 79 | 32 | 11 | 4.86 |
| 1121458 | 66 | 57 | 21 | 14 | 2.13 |
| 1121462 | 37 | 46 | 18 | 8 | <0.7 |
| 1121470 | 54 | 39 | 17 | 7 | 0.93 |
| 1121474 | 45 | 32 | 20 | 16 | <0.7 |
| 1121557 | 54 | 30 | 13 | 5 | 0.75 |
| 1121613 | 186 | 153 | 16 | 32 | 9.04 |

Example 8: Dose-Dependent Inhibition of Human PLN in iCell® Cardiomyocytes² by Modified Oligonucleotides Modified oligonucleotides selected from the examples above were tested at various doses in iCell® cardiomyocytes² (FujiFilm Cellular Dynamics, Inc.; Catalog No: R1017). Cultured iCell® cardiomyocytes² at a density of 8,000 cells per well were treated by free uptake with various concentrations of modified oligonucleotide as specified in the tables below. After a treatment period of approximately 72 hours, total RNA was isolated from the cells, and PLN RNA levels were measured by quantitative real-time RTPCR. Human PLN primer-probe set RTS40402 (described herein above) was used to measure RNA levels as described above. PLN RNA levels were normalized to total RNA content, as measured by RIBOGREEN®. Reduction of PLN RNA is presented in the tables below as percent PLN RNA, relative to untreated control cells (% UTC).

The half maximal inhibitory concentration ($IC_{50}$) of each modified oligonucleotide was calculated using a linear regression on a log/linear plot of the data in Excel and is also presented in the tables below.

TABLE 28

| Dose-dependent reduction of human PLN RNA in iCell ® cardiomyocytes[2] by modified oligonucleotides | | | | | |
|---|---|---|---|---|---|
| Compound | PLN RNA (% UTC) | | | | $IC_{50}$ |
| No. | 80 nM | 400 nM | 2000 nM | 10000 nM | (μM) |
| 1121455 | 67 | 52 | 17 | 4 | 0.31 |
| 1342169 | 75 | 57 | 27 | 12 | 0.53 |
| 1342213 | 102 | 99 | 67 | 58 | >10.0 |
| 1342341 | 70 | 29 | 13 | 4 | 0.18 |
| 1342548 | 63 | 64 | 30 | 10 | 0.44 |
| 1342606 | 76 | 58 | 25 | 6 | 0.50 |
| 1342689 | 81 | 54 | 22 | 4 | 0.49 |
| 1342725 | 92 | 83 | 69 | 46 | >10.0 |
| 1342738 | 84 | 70 | 52 | 17 | 1.39 |
| 1342872 | 79 | 56 | 20 | 7 | 0.49 |
| 1343049 | 96 | 54 | 31 | 8 | 0.77 |
| 1343077 | 57 | 36 | 11 | 3 | 0.12 |
| 1343108 | 93 | 113 | 81 | 48 | >10.0 |
| 1343112 | 69 | 43 | 19 | 6 | 0.27 |
| 1343124 | 61 | 49 | 29 | 11 | 0.27 |
| 1343141 | 45 | 21 | 6 | 2 | <0.08 |
| 1343142 | 94 | 50 | 15 | 3 | 0.55 |
| 1343173 | 91 | 62 | 26 | 9 | 0.75 |
| 1343185 | 88 | 79 | 78 | 48 | >10.0 |

TABLE 29

| Dose-dependent reduction of human PLN RNA in iCell ® cardiomyocytes[2] by modified oligonucleotides | | | | | |
|---|---|---|---|---|---|
| Compound | PLN RNA (% UTC) | | | | $IC_{50}$ |
| No. | 80 nM | 400 nM | 2000 nM | 10000 nM | (μM) |
| 1121455 | 30 | 41 | 12 | 3 | <0.08 |
| 1342250 | 107 | 74 | 40 | 12 | 1.34 |
| 1342381 | 105 | 88 | 30 | 7 | 1.27 |
| 1342411 | 125 | 117 | 83 | 13 | 4.00 |
| 1342420 | 89 | 65 | 24 | 4 | 0.70 |
| 1342436 | 118 | 80 | 41 | 10 | 1.54 |
| 1342488 | 101 | 52 | 18 | 5 | 0.66 |
| 1342597 | 112 | 103 | 56 | 16 | 2.56 |
| 1342630 | 133 | 69 | 42 | 14 | 1.64 |
| 1342737 | 85 | 60 | 20 | 11 | 0.62 |
| 1342759 | 79 | 66 | 32 | 11 | 0.74 |
| 1342858 | 92 | 84 | 87 | 78 | >10.0 |
| 1342898 | 89 | 76 | 31 | 10 | 0.98 |
| 1342964 | 65 | 35 | 9 | 3 | 0.17 |
| 1343021 | 126 | 140 | 61 | 30 | 4.94 |
| 1343100 | 99 | 66 | 26 | 8 | 0.88 |
| 1343127 | 55 | 26 | 6 | 3 | <0.08 |
| 1343130 | 138 | 114 | 53 | 13 | 2.69 |
| 1343200 | 130 | 85 | 33 | 15 | 1.70 |

TABLE 30

| Dose-dependent reduction of human PLN RNA in iCell ® cardiomyocytes[2] by modified oligonucleotides | | | | | |
|---|---|---|---|---|---|
| Compound | PLN RNA (% UTC) | | | | $IC_{50}$ |
| No. | 80 nM | 400 nM | 2000 nM | 10000 nM | (μM) |
| 1121455 | 81 | 52 | 20 | 3 | 0.46 |
| 1342179 | 91 | 79 | 44 | 14 | 1.34 |
| 1342270 | 87 | 63 | 24 | 10 | 0.70 |
| 1342309 | 110 | 90 | 37 | 8 | 1.50 |
| 1342325 | 113 | 98 | 96 | 59 | >10.0 |
| 1342360 | 112 | 83 | 47 | 18 | 1.90 |
| 1342379 | 103 | 92 | 74 | 37 | 6.55 |

TABLE 30-continued

| Dose-dependent reduction of human PLN RNA in iCell ® cardiomyocytes[2] by modified oligonucleotides | | | | | |
|---|---|---|---|---|---|
| Compound | PLN RNA (% UTC) | | | | $IC_{50}$ |
| No. | 80 nM | 400 nM | 2000 nM | 10000 nM | (μM) |
| 1342401 | 118 | 140 | 91 | 53 | >10.0 |
| 1342428 | 95 | 89 | 44 | 16 | 1.67 |
| 1342645 | 101 | 84 | 54 | 19 | 2.08 |
| 1342680 | 106 | 102 | 63 | 25 | 3.49 |
| 1342718 | 141 | 88 | 47 | 9 | 1.94 |
| 1342812 | 87 | 66 | 34 | 8 | 0.83 |
| 1342873 | 51 | 27 | 9 | 2 | <0.08 |
| 1342959 | 103 | 96 | 66 | 28 | 3.91 |
| 1342983 | 98 | 86 | 90 | 80 | >10.0 |
| 1343091 | 108 | 75 | 38 | 14 | 1.40 |
| 1343098 | 103 | 78 | 35 | 10 | 1.25 |
| 1343154 | 100 | 88 | 48 | 10 | 1.62 |

TABLE 31

| Dose-dependent reduction of human PLN RNA in iCell ® cardiomyocytes[2] by modified oligonucleotides | | | | | |
|---|---|---|---|---|---|
| Compound | PLN RNA (% UTC) | | | | $IC_{50}$ |
| No. | 80 nM | 400 nM | 2000 nM | 10000 nM | (μM) |
| 1121455 | 78 | 50 | 17 | 4 | 0.40 |
| 1342254 | 111 | 83 | 33 | 8 | 1.32 |
| 1342445 | 85 | 76 | 55 | 34 | 2.91 |
| 1342514 | 112 | 80 | 37 | 12 | 1.45 |
| 1342551 | 81 | 46 | 15 | 5 | 0.39 |
| 1342552 | 107 | 71 | 29 | 8 | 1.07 |
| 1342576 | 92 | 87 | 30 | 6 | 1.08 |
| 1342749 | 68 | 46 | 13 | 3 | 0.26 |
| 1343101 | 92 | 86 | 53 | 17 | 1.86 |
| 1343103 | 79 | 50 | 15 | 5 | 0.41 |
| 1343241 | 112 | 87 | 53 | 16 | 2.09 |
| 1343255 | 101 | 63 | 24 | 6 | 0.84 |
| 1343264 | 79 | 71 | 47 | 18 | 1.21 |
| 1343275 | 95 | 60 | 24 | 8 | 0.75 |
| 1343277 | 72 | 56 | 23 | 11 | 0.44 |
| 1343452 | 81 | 73 | 33 | 14 | 0.91 |
| 1343467 | 84 | 72 | 31 | 11 | 0.87 |
| 1343479 | 80 | 73 | 49 | 28 | 1.78 |
| 1343493 | 101 | 81 | 41 | 23 | 1.75 |

TABLE 32

| Dose-dependent reduction of human PLN RNA in iCell ® cardiomyocytes[2] by modified oligonucleotides | | | | | |
|---|---|---|---|---|---|
| Compound | PLN RNA (% UTC) | | | | $IC_{50}$ |
| No. | 80 nM | 400 nM | 2000 nM | 10000 nM | (μM) |
| 1121455 | 71 | 44 | 14 | 4 | 0.27 |
| 1343259 | 113 | 88 | 44 | 13 | 1.75 |
| 1343278 | 90 | 53 | 23 | 8 | 0.60 |
| 1343320 | 78 | 62 | 34 | 20 | 0.80 |
| 1343401 | 106 | 85 | 44 | 17 | 1.77 |
| 1343429 | 104 | 70 | 32 | 9 | 1.07 |
| 1343443 | 115 | 106 | 94 | 64 | >10.0 |
| 1343461 | 84 | 76 | 44 | 15 | 1.23 |
| 1343475 | 72 | 39 | 10 | 3 | 0.25 |
| 1343478 | 78 | 40 | 17 | 5 | 0.32 |
| 1343488 | 89 | 70 | 43 | 14 | 1.15 |
| 1343495 | 74 | 42 | 15 | 5 | 0.30 |
| 1343523 | 82 | 74 | 45 | 17 | 1.25 |
| 1343548 | 108 | 55 | 40 | 15 | 1.14 |

TABLE 32-continued

Dose-dependent reduction of human PLN RNA in iCell ® cardiomyocytes[2] by modified oligonucleotides

| Compound No. | PLN RNA (% UTC) 80 nM | 400 nM | 2000 nM | 10000 nM | $IC_{50}$ (μM) |
|---|---|---|---|---|---|
| 1343558 | 94 | 75 | 33 | 11 | 1.07 |
| 1343571 | 100 | 88 | 39 | 14 | 1.51 |
| 1343574 | 79 | 70 | 41 | 14 | 0.97 |
| 1343583 | 73 | 73 | 36 | 11 | 0.78 |
| 1343595 | 81 | 58 | 29 | 12 | 0.65 |

TABLE 33

Dose-dependent reduction of human PLN RNA in iCell ® cardiomyocytes[2] by modified oligonucleotides

| Compound No. | PLN RNA (% UTC) 80 nM | 400 nM | 2000 nM | 10000 nM | $IC_{50}$ (μM) |
|---|---|---|---|---|---|
| 1121455 | 90 | 66 | 32 | 8 | 0.84 |
| 1342178 | 119 | 108 | 61 | 26 | 3.65 |
| 1342235 | 95 | 72 | 33 | 15 | 1.09 |
| 1342284 | 96 | 74 | 28 | 6 | 0.95 |
| 1342342 | 98 | 85 | 37 | 8 | 1.29 |
| 1342412 | 112 | 51 | 14 | 5 | 0.74 |
| 1342475 | 96 | 75 | 37 | 8 | 1.11 |
| 1342536 | 124 | 90 | 46 | 12 | 1.89 |
| 1342636 | 76 | 39 | 13 | 2 | 0.29 |
| 1342709 | 101 | 89 | 79 | 23 | 4.10 |
| 1342846 | 131 | 111 | 69 | 35 | 5.33 |
| 1342920 | 82 | 55 | 23 | 7 | 0.53 |
| 1342944 | 85 | 51 | 13 | 4 | 0.46 |
| 1342949 | 115 | 79 | 37 | 12 | 1.47 |
| 1342996 | 102 | 75 | 36 | 13 | 1.26 |
| 1343056 | 138 | 124 | 85 | 28 | 5.97 |
| 1343081 | 118 | 115 | 79 | 35 | 7.12 |
| 1343134 | 100 | 49 | 17 | 5 | 0.61 |
| 1343208 | 98 | 84 | 79 | 46 | >10.0 |

TABLE 34

Dose-dependent reduction of human PLN RNA in iCell ® cardiomyocytes[2] by modified oligonucleotides

| Compound No. | PLN RNA (% UTC) 80 nM | 400 nM | 2000 nM | 10000 nM | $IC_{50}$ (μM) |
|---|---|---|---|---|---|
| 1121455 | 92 | 66 | 25 | 8 | 0.79 |
| 1342173 | 109 | 94 | 44 | 12 | 1.80 |
| 1342256 | 88 | 49 | 12 | 4 | 0.46 |
| 1342407 | 91 | 65 | 26 | 8 | 0.78 |
| 1342460 | 99 | 115 | 92 | 70 | >10.0 |
| 1342508 | 108 | 89 | 44 | 14 | 1.76 |
| 1342614 | 99 | 75 | 30 | 5 | 1.00 |
| 1342649 | 105 | 96 | 45 | 15 | 1.94 |
| 1342770 | 155 | 152 | 66 | 17 | 4.15 |
| 1342785 | 96 | 84 | 35 | 6 | 1.17 |
| 1342794 | 91 | 68 | 43 | 13 | 1.14 |
| 1342819 | 134 | 113 | 57 | 19 | 3.05 |
| 1342849 | 149 | 94 | 47 | 10 | 2.12 |
| 1342882 | 115 | 117 | 86 | 40 | >10.0 |
| 1342919 | 106 | 69 | 30 | 4 | 0.99 |
| 1342989 | 120 | 87 | 41 | 8 | 1.61 |
| 1343040 | 129 | 113 | 61 | 16 | 3.03 |
| 1343093 | 119 | 101 | 64 | 13 | 2.69 |
| 1343169 | 123 | 84 | 30 | 7 | 1.39 |

TABLE 35

Dose-dependent reduction of human PLN RNA in iCell ® cardiomyocytes[2] by modified oligonucleotides

| Compound No. | PLN RNA (% UTC) 80 nM | 400 nM | 2000 nM | 10000 nM | $IC_{50}$ (μM) |
|---|---|---|---|---|---|
| 1121455 | 79 | 54 | 22 | 4 | 0.46 |
| 1343339 | 96 | 55 | 22 | 8 | 0.70 |
| 1343360 | 68 | 37 | 14 | 5 | 0.22 |
| 1343362 | 78 | 40 | 19 | 7 | 0.35 |
| 1343367 | 80 | 61 | 23 | 4 | 0.54 |
| 1343382 | 86 | 53 | 19 | 7 | 0.54 |
| 1343390 | 103 | 74 | 38 | 19 | 1.44 |
| 1343528 | 88 | 76 | 52 | 16 | 1.55 |
| 1343535 | 101 | 78 | 38 | 8 | 1.22 |
| 1343547 | 73 | 73 | 48 | 14 | 1.06 |
| 1343580 | 122 | 81 | 47 | 11 | 1.73 |
| 1343582 | 98 | 58 | 32 | 10 | 0.86 |
| 1343603 | 81 | 83 | 43 | 17 | 1.36 |
| 1343619 | 93 | 70 | 41 | 13 | 1.16 |
| 1343647 | 56 | 48 | 24 | 10 | 0.19 |
| 1343651 | 88 | 39 | 17 | 6 | 0.42 |
| 1343654 | 97 | 77 | 41 | 11 | 1.29 |
| 1343656 | 68 | 65 | 33 | 7 | 0.53 |
| 1343666 | 85 | 59 | 20 | 6 | 0.57 |

TABLE 36

Dose-dependent reduction of human PLN RNA in iCell ® cardiomyocytes[2] by modified oligonucleotides

| Compound No. | PLN RNA (% UTC) 80 nM | 400 nM | 2000 nM | 10000 nM | $IC_{50}$ (μM) |
|---|---|---|---|---|---|
| 1091598 | 58 | 33 | 8 | 1 | 0.11 |
| 1121455 | 81 | 59 | 20 | 4 | 0.52 |
| 1342161 | 92 | 77 | 35 | 9 | 1.06 |
| 1342205 | 84 | 50 | 11 | 3 | 0.42 |
| 1342417 | 116 | 112 | 116 | 106 | >10.0 |
| 1342457 | 72 | 68 | 42 | 9 | 0.76 |
| 1342569 | 90 | 59 | 23 | 5 | 0.66 |
| 1342581 | 108 | 78 | 49 | 12 | 1.63 |
| 1342586 | 52 | 41 | 17 | 4 | 0.11 |
| 1342639 | 66 | 56 | 40 | 9 | 0.49 |
| 1342668 | 81 | 33 | 6 | 1 | 0.27 |
| 1342698 | 77 | 45 | 13 | 4 | 0.34 |
| 1342876 | 108 | 93 | 43 | 13 | 1.79 |
| 1342911 | 74 | 31 | 12 | 4 | 0.22 |
| 1342952 | 70 | 65 | 24 | 6 | 0.49 |
| 1343011 | 76 | 77 | 47 | 8 | 1.03 |
| 1343020 | 82 | 72 | 35 | 10 | 0.87 |
| 1343063 | 93 | 78 | 45 | 9 | 1.28 |
| 1343113 | 92 | 73 | 37 | 8 | 1.03 |

TABLE 37

Dose-dependent reduction of human PLN RNA in iCell ® cardiomyocytes[2] by modified oligonucleotides

| Compound No. | PLN RNA (% UTC) 80 nM | 400 nM | 2000 nM | 10000 nM | $IC_{50}$ (μM) |
|---|---|---|---|---|---|
| 1121455 | 81 | 70 | 33 | 9 | 0.80 |
| 1342190 | 82 | 50 | 14 | 4 | 0.43 |
| 1342226 | 67 | 72 | 47 | 17 | 0.96 |
| 1342285 | 122 | 123 | 68 | 29 | 4.94 |
| 1342334 | 116 | 96 | 75 | 23 | 3.89 |
| 1342348 | 90 | 87 | 45 | 13 | 1.49 |
| 1342410 | 92 | 96 | 74 | 33 | 5.97 |

TABLE 37-continued

Dose-dependent reduction of human PLN RNA in iCell ® cardiomyocytes[2] by modified oligonucleotides

| Compound | PLN RNA (% UTC) | | | | $IC_{50}$ |
|---|---|---|---|---|---|
| No. | 80 nM | 400 nM | 2000 nM | 10000 nM | (μM) |
| 1342493 | 96 | 72 | 39 | 8 | 1.09 |
| 1342584 | 114 | 103 | 56 | 18 | 2.69 |
| 1342621 | 122 | 105 | 65 | 22 | 3.43 |
| 1342629 | 89 | 102 | 65 | 38 | 6.84 |
| 1342661 | 80 | 69 | 38 | 8 | 0.82 |
| 1342705 | 98 | 74 | 35 | 4 | 1.04 |
| 1342787 | 92 | 70 | 32 | 10 | 0.95 |
| 1342840 | 107 | 90 | 78 | 39 | 7.31 |
| 1342843 | 105 | 74 | 54 | 22 | 2.00 |
| 1342887 | 78 | 64 | 30 | 8 | 0.64 |
| 1342905 | 93 | 65 | 34 | 12 | 0.94 |
| 1343188 | 91 | 77 | 44 | 15 | 1.36 |

TABLE 38

Dose-dependent reduction of human PLN RNA in iCell ® cardiomyocytes[2] by modified oligonucleotides

| Compound | PLN RNA (% UTC) | | | | $IC_{50}$ |
|---|---|---|---|---|---|
| No. | 80 nM | 400 nM | 2000 nM | 10000 nM | (μM) |
| 1121455 | 85 | 60 | 27 | 8 | 0.65 |
| 1342168 | 86 | 70 | 43 | 12 | 1.06 |
| 1342311 | 93 | 92 | 72 | 34 | 5.67 |
| 1342535 | 85 | 53 | 15 | 13 | 0.52 |
| 1342851 | 95 | 84 | 55 | 22 | 2.21 |
| 1343014 | 93 | 102 | 90 | 31 | 9.47 |
| 1343182 | 119 | 67 | 36 | 9 | 1.28 |
| 1343357 | 83 | 57 | 31 | 10 | 0.66 |
| 1343516 | 132 | 114 | 66 | 25 | 3.91 |
| 1343608 | 109 | 93 | 45 | 19 | 2.08 |
| 1343629 | 79 | 53 | 20 | 5 | 0.46 |
| 1343630 | 121 | 84 | 60 | 15 | 2.31 |
| 1343631 | 105 | 83 | 45 | 16 | 1.70 |
| 1343648 | 79 | 51 | 19 | 6 | 0.43 |
| 1343653 | 126 | 81 | 38 | 14 | 1.66 |
| 1343664 | 98 | 83 | 45 | 14 | 1.56 |
| 1343665 | 89 | 57 | 30 | 8 | 0.72 |
| 1343671 | 79 | 58 | 16 | 5 | 0.47 |
| 1343685 | 132 | 112 | 60 | 38 | 4.93 |

TABLE 39

Dose-dependent reduction of human PLN RNA in iCell ® cardiomyocytes[2] by modified oligonucleotides

| Compound | PLN RNA (% UTC) | | | | $IC_{50}$ |
|---|---|---|---|---|---|
| No. | 370 nM | 1111 nM | 3333 nM | 10000 nM | (μM) |
| 1343141 | 47 | 26 | 9 | 3 | <0.37 |
| 1393379 | 60 | 33 | 31 | 10 | 0.58 |
| 1393382 | 59 | 32 | 17 | 6 | 0.50 |
| 1393387 | 55 | 25 | 7 | 2 | <0.37 |
| 1393388 | 44 | 26 | 9 | 2 | <0.37 |
| 1393391 | 72 | 48 | 27 | 7 | 1.06 |
| 1393403 | 68 | 40 | 15 | 8 | 0.76 |
| 1393440 | 63 | 37 | 16 | 7 | 0.65 |
| 1393444 | 64 | 31 | 15 | 5 | 0.58 |
| 1393531 | 65 | 51 | 27 | 10 | 0.98 |
| 1393549 | 76 | 55 | 30 | 9 | 1.33 |
| 1393556 | 65 | 29 | 13 | 3 | 0.57 |
| 1393790 | 50 | 29 | 18 | 10 | <0.37 |
| 1393921 | 66 | 31 | 10 | 3 | 0.59 |

TABLE 39-continued

Dose-dependent reduction of human PLN RNA in iCell ® cardiomyocytes[2] by modified oligonucleotides

| Compound | PLN RNA (% UTC) | | | | $IC_{50}$ |
|---|---|---|---|---|---|
| No. | 370 nM | 1111 nM | 3333 nM | 10000 nM | (μM) |
| 1393923 | 75 | 40 | 19 | 5 | 0.93 |
| 1393926 | 50 | 26 | 7 | 2 | <0.37 |
| 1393953 | 66 | 39 | 16 | 6 | 0.72 |
| 1393989 | 59 | 67 | 29 | 11 | 1.14 |
| 1394104 | 71 | 52 | 27 | 9 | 1.13 |

TABLE 40

Dose-dependent reduction of human PLN RNA in iCell ® cardiomyocytes[2] by modified oligonucleotides

| Compound | PLN RNA (% UTC) | | | | $IC_{50}$ |
|---|---|---|---|---|---|
| No. | 370 nM | 1111 nM | 3333 nM | 10000 nM | (μM) |
| 1343141 | 54 | 31 | 13 | 5 | 0.38 |
| 1393376 | 85 | 58 | 35 | 16 | 1.79 |
| 1393398 | 78 | 53 | 31 | 16 | 1.45 |
| 1393669 | 77 | 65 | 33 | 11 | 1.63 |
| 1393672 | 73 | 59 | 29 | 12 | 1.35 |
| 1393673 | 82 | 55 | 26 | 8 | 1.39 |
| 1393674 | 75 | 53 | 27 | 10 | 1.23 |
| 1393675 | 58 | 39 | 23 | 12 | 0.57 |
| 1393682 | 52 | 31 | 10 | 6 | <0.37 |
| 1393694 | 74 | 24 | 27 | 10 | 0.75 |
| 1393705 | 76 | 45 | 21 | 8 | 1.05 |
| 1393722 | 42 | 25 | 14 | 6 | <0.37 |
| 1393723 | 59 | 46 | 25 | 13 | 0.72 |
| 1393727 | 79 | 61 | 32 | 14 | 1.62 |
| 1393737 | 71 | 55 | 29 | 10 | 1.22 |
| 1393741 | 52 | 30 | 16 | 8 | <0.37 |
| 1393743 | 56 | 32 | 17 | 8 | 0.44 |
| 1393749 | 62 | 46 | 27 | 11 | 0.82 |
| 1393876 | 83 | 61 | 34 | 18 | 1.82 |

TABLE 41

Dose-dependent reduction of human PLN RNA in iCell ® cardiomyocytes[2] by modified oligonucleotides

| Compound | PLN RNA (% UTC) | | | | $IC_{50}$ |
|---|---|---|---|---|---|
| No. | 370 nM | 1111 nM | 3333 nM | 10000 nM | (μM) |
| 1343141 | 48 | 23 | 8 | 3 | <0.37 |
| 1393486 | 79 | 40 | 19 | 5 | 1.01 |
| 1393490 | 58 | 53 | 28 | 14 | 0.84 |
| 1393493 | 66 | 27 | 9 | 3 | 0.54 |
| 1393503 | 84 | 67 | 55 | 33 | 3.70 |
| 1393525 | 46 | 34 | 18 | 11 | <0.37 |
| 1393540 | 81 | 69 | 49 | 37 | 3.67 |
| 1393562 | 63 | 35 | 17 | 7 | 0.61 |
| 1393757 | 48 | 27 | 11 | 7 | <0.37 |
| 1393760 | 49 | 26 | 13 | 5 | <0.37 |
| 1393766 | 66 | 39 | 19 | 8 | 0.74 |
| 1393770 | 61 | 44 | 22 | 9 | 0.72 |
| 1393771 | 60 | 33 | 14 | 5 | 0.51 |
| 1393772 | 59 | 31 | 13 | 4 | 0.48 |
| 1394029 | 69 | 37 | 18 | 7 | 0.76 |
| 1394031 | 68 | 46 | 26 | 11 | 0.95 |
| 1394038 | 58 | 30 | 15 | 8 | 0.44 |
| 1394039 | 90 | 91 | 74 | 57 | >10.0 |
| 1394043 | 71 | 45 | 27 | 9 | 1.00 |

TABLE 42

Dose-dependent reduction of human PLN RNA in iCell ® cardiomyocytes[2] by modified oligonucleotides

| Compound | PLN RNA (% UTC) | | | | $IC_{50}$ |
|---|---|---|---|---|---|
| No. | 370 nM | 1111 nM | 3333 nM | 10000 nM | (μM) |
| 1343141 | 43 | 22 | 9 | 4 | <0.37 |
| 1393568 | 58 | 40 | 23 | 12 | 0.60 |
| 1393575 | 62 | 39 | 19 | 10 | 0.65 |
| 1393581 | 54 | 32 | 19 | 9 | 0.38 |
| 1393862 | 56 | 36 | 20 | 11 | 0.47 |
| 1393864 | 67 | 54 | 32 | 17 | 1.17 |
| 1393867 | 59 | 44 | 26 | 15 | 0.69 |
| 1393893 | 69 | 44 | 23 | 10 | 0.91 |
| 1393895 | 80 | 69 | 52 | 38 | 4.09 |
| 1393920 | 66 | 51 | 35 | 23 | 1.20 |
| 1393922 | 68 | 45 | 23 | 12 | 0.92 |
| 1393956 | 50 | 31 | 16 | 9 | <0.37 |
| 1393958 | 48 | 39 | 26 | 11 | <0.37 |
| 1393965 | 94 | 73 | 56 | 44 | 5.75 |
| 1393983 | 70 | 42 | 28 | 12 | 0.95 |
| 1393988 | 59 | 44 | 25 | 16 | 0.70 |
| 1393997 | 51 | 39 | 21 | 9 | 0.41 |

TABLE 43

Dose-dependent reduction of human PLN RNA in iCell ® cardiomyocytes[2] by modified oligonucleotides

| Compound | PLN RNA (% UTC) | | | | $IC_{50}$ |
|---|---|---|---|---|---|
| No. | 370 nM | 1111 nM | 3333 nM | 10000 nM | (μM) |
| 1343141 | 40 | 22 | 8 | 3 | <0.37 |
| 1393586 | 52 | 29 | 12 | 4 | <0.37 |
| 1393603 | 49 | 26 | 14 | 9 | <0.37 |
| 1393606 | 60 | 35 | 18 | 9 | 0.53 |
| 1393614 | 54 | 30 | 16 | 8 | 0.37 |
| 1393621 | 59 | 31 | 15 | 6 | 0.47 |
| 1393622 | 63 | 38 | 13 | 3 | 0.65 |
| 1393626 | 87 | 84 | 77 | 70 | >10.0 |
| 1393627 | 91 | 81 | 70 | 54 | >10.0 |
| 1393652 | 46 | 33 | 18 | 16 | <0.37 |
| 1393655 | 45 | 22 | 7 | 3 | <0.37 |
| 1393662 | 54 | 26 | 11 | 3 | <0.37 |
| 1393664 | 78 | 52 | 32 | 15 | 1.40 |
| 1393688 | 91 | 87 | 72 | 47 | >10.0 |
| 1393696 | 63 | 41 | 19 | 9 | 0.70 |
| 1393718 | 69 | 50 | 38 | 18 | 1.26 |
| 1393724 | 52 | 37 | 17 | 10 | 0.40 |
| 1393732 | 63 | 40 | 21 | 12 | 0.68 |
| 1393738 | 82 | 66 | 38 | 21 | 2.13 |

TABLE 44

Dose-dependent reduction of human PLN RNA in iCell ® cardiomyocytes[2] by modified oligonucleotides

| Compound | PLN RNA (% UTC) | | | | $IC_{50}$ |
|---|---|---|---|---|---|
| No. | 370 nM | 1111 nM | 3333 nM | 10000 nM | (μM) |
| 1343141 | 38 | 18 | 6 | 2 | <0.37 |
| 1393367 | 50 | 24 | 9 | 4 | <0.37 |
| 1393369 | 58 | 43 | 16 | 6 | 0.60 |
| 1393371 | 75 | 55 | 27 | 12 | 1.30 |
| 1393372 | 65 | 39 | 17 | 5 | 0.71 |
| 1393400 | 69 | 51 | 28 | 10 | 1.10 |
| 1393450 | 89 | 93 | 82 | 70 | >10.0 |
| 1393453 | 67 | 40 | 24 | 10 | 0.82 |
| 1393464 | 76 | 45 | 17 | 4 | 1.00 |

TABLE 44-continued

Dose-dependent reduction of human PLN RNA in iCell ® cardiomyocytes[2] by modified oligonucleotides

| Compound | PLN RNA (% UTC) | | | | $IC_{50}$ |
|---|---|---|---|---|---|
| No. | 370 nM | 1111 nM | 3333 nM | 10000 nM | (μM) |
| 1393775 | 64 | 41 | 21 | 7 | 0.74 |
| 1393784 | 49 | 29 | 19 | 12 | <0.37 |
| 1393791 | 58 | 31 | 18 | 11 | <0.37 |
| 1393807 | 49 | 30 | 18 | 11 | <0.37 |
| 1393809 | 38 | 20 | 10 | 5 | <0.37 |
| 1393885 | 56 | 34 | 18 | 7 | 0.47 |
| 1393892 | 63 | 36 | 22 | 11 | 0.65 |
| 1393906 | 59 | 31 | 14 | 7 | 0.48 |
| 1393916 | 67 | 50 | 26 | 12 | 1.01 |
| 1393924 | 46 | 26 | 16 | 7 | <0.37 |

TABLE 45

Dose-dependent reduction of human PLN RNA in iCell ® cardiomyocytes[2] by modified oligonucleotides

| Compound | PLN RNA (% UTC) | | | | $IC_{50}$ |
|---|---|---|---|---|---|
| No. | 80 nM | 400 nM | 2000 nM | 10000 nM | (μM) |
| 1121441 | 76 | 55 | 35 | 10 | 0.58 |
| 1343077 | 65 | 49 | 22 | 9 | 0.29 |
| 1343475 | 55 | 40 | 17 | 8 | 0.13 |
| 1343648 | 80 | 61 | 28 | 11 | 0.64 |
| 1393575 | 86 | 70 | 33 | 14 | 0.94 |
| 1393772 | 76 | 59 | 29 | 11 | 0.57 |
| 1528612 | 65 | 49 | 28 | 11 | 0.33 |
| 1528613 | 55 | 37 | 17 | 9 | 0.11 |
| 1528625 | 89 | 51 | 22 | 10 | 0.58 |
| 1528630 | 81 | 55 | 23 | 9 | 0.53 |
| 1528632 | 56 | 48 | 29 | 10 | 0.21 |
| 1528633 | 71 | 47 | 21 | 9 | 0.33 |
| 1528643 | 80 | 67 | 29 | 12 | 0.74 |
| 1528644 | 86 | 62 | 33 | 15 | 0.84 |
| 1528646 | 73 | 61 | 38 | 16 | 0.71 |
| 1528650 | 64 | 52 | 16 | 7 | 0.27 |
| 1528663 | 63 | 72 | 35 | 8 | 0.59 |
| 1528681 | 68 | 51 | 29 | 13 | 0.37 |
| 1528842 | 84 | 53 | 25 | 7 | 0.56 |

TABLE 46

Dose-dependent reduction of human PLN RNA in iCell ® cardiomyocytes[2] by modified oligonucleotides

| Compound | PLN RNA (% UTC) | | | | $IC_{50}$ |
|---|---|---|---|---|---|
| No. | 80 nM | 400 nM | 2000 nM | 10000 nM | (μM) |
| 1343467 | 63 | 59 | 44 | 21 | 0.62 |
| 1343648 | 88 | 67 | 33 | 13 | 0.90 |
| 1393581 | 87 | 74 | 47 | 18 | 1.43 |
| 1393675 | 74 | 55 | 33 | 19 | 0.59 |
| 1528609 | 73 | 73 | 46 | 22 | 1.20 |
| 1528629 | 66 | 47 | 28 | 12 | 0.31 |
| 1528631 | 74 | 79 | 45 | 16 | 1.17 |
| 1528634 | 80 | 75 | 38 | 14 | 1.00 |
| 1528639 | 82 | 60 | 41 | 18 | 0.91 |
| 1528649 | 80 | 66 | 30 | 9 | 0.70 |
| 1528654 | 101 | 76 | 51 | 17 | 1.71 |
| 1528661 | 69 | 56 | 27 | 14 | 0.44 |
| 1528662 | 102 | 94 | 45 | 12 | 1.76 |
| 1528671 | 87 | 67 | 39 | 14 | 1.00 |
| 1528674 | 88 | 72 | 38 | 21 | 1.24 |
| 1528677 | 83 | 54 | 33 | 14 | 0.67 |

TABLE 46-continued

| Dose-dependent reduction of human PLN RNA in iCell ® cardiomyocytes[2] by modified oligonucleotides | | | | | |
|---|---|---|---|---|---|
| Compound | PLN RNA (% UTC) | | | | $IC_{50}$ |
| No. | 80 nM | 400 nM | 2000 nM | 10000 nM | (μM) |
| 1528682 | 81 | 55 | 33 | 10 | 0.63 |
| 1528855 | 83 | 72 | 41 | 21 | 1.23 |
| 1528858 | 88 | 64 | 44 | 21 | 1.22 |

Example 9: Design of Modified Oligonucleotides Complementary to Human PLN Nucleic Acid Modified oligonucleotides complementary to a human PLN nucleic acid were designed, as described in the tables below. "Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the tables below is 100% complementary to SEQ ID NO: 1 (described herein above), to SEQ ID NO: 2 (described herein above), or to both. 'N/A' indicates that the modified oligonucleotide is not 100% complementary to that particular target nucleic acid sequence.

Each modified oligonucleotide in the tables below is conjugated to a 6-palmitamidohexyl phosphate conjugate group attached to the 5'-OH of the oligonucleotide. The structure for the conjugate group is:

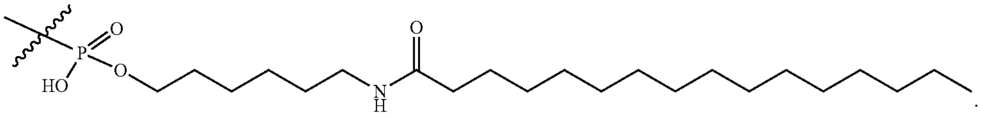

.

The modified oligonucleotides in Tables 47-50 below are 3-10-3 cEt modified oligonucleotides with uniform phosphorothioate internucleoside linkages. The modified oligonucleotides are 16 nucleosides in length, wherein the central gap segment consists of ten 2'-β-D-deoxynucleosides, and wherein the 5' and 3' wing segments each consist of three cEt nucleosides. The sugar motif for the modified oligonucleotides is (from 5' to 3'): kkkddddddddddkkk; wherein each "d" represents a 2'-β-D-deoxyribosyl sugar moiety, and each "k" represents a cEt modified sugar moiety. The modified oligonucleotides have an internucleoside linkage motif of (from 5' to 3'): sssssssssssssss; wherein each "s" represents a phosphorothioate internucleoside linkage. Each cytosine residue is a 5-methyl cytosine.

TABLE 47

6-palmitamidohexyl-conjugated modified oligonucleotides with a 3-10-3 cEt sugar motif and uniform PS internucleoside linkages complementary to human PLN

| Compound Number | Sequence (5' to 3') | SEQ ID No: 1 Start Site | SEQ ID No: 1 Stop Site | SEQ ID No: 2 Start Site | SEQ ID No: 2 Stop Site | SEQ ID NO. |
|---|---|---|---|---|---|---|
| 1436539 | ATTACTTTGATACTTG | 823 | 838 | 14517 | 14532 | 260 |
| 1436540 | TATGTAAGAGTATGGC | 1017 | 1032 | 14711 | 14726 | 186 |
| 1436542 | ACACGAGTATATTAGG | N/A | N/A | 5501 | 5516 | 609 |
| 1436543 | GTAGTTAAGATTTTGC | 1530 | 1545 | 15224 | 15239 | 752 |
| 1436544 | CACGAGTATATTAGGA | N/A | N/A | 5500 | 5515 | 675 |
| 1436545 | GAATGTAATGCTATGC | N/A | N/A | 5850 | 5865 | 732 |
| 1436546 | GGAAATCAACAGTTGC | 625 | 640 | 14319 | 14334 | 564 |
| 1443233 | AAGATATAGTATGGTA | 1247 | 1262 | 14941 | 14956 | 45 |
| 1443234 | TCTGATAGTTACTACA | 914 | 929 | 14608 | 14623 | 35 |
| 1443235 | CCATACTTGATTCTCA | 992 | 1007 | 14686 | 14701 | 185 |

TABLE 47-continued 6-palmitamidohexyl-conjugated modified oligonucleotides with a 3-10-3 cEt sugar motif and uniform PS internucleoside linkages complementary to human PLN

| Compound Number | Sequence (5' to 3') | SEQ ID No: 1 Start Site | SEQ ID No: 1 Stop Site | SEQ ID No: 2 Start Site | SEQ ID No: 2 Stop Site | SEQ ID NO. |
|---|---|---|---|---|---|---|
| 1443236 | ATGTACTAGAATTCTG | 1069 | 1084 | 14763 | 14778 | 112 |
| 1443237 | TAGTATTGAGAAAGTC | N/A | N/A | 6408 | 6423 | 301 |
| 1443238 | CATGTTTACAAGATCC | 561 | 576 | 14255 | 14270 | 91 |
| 1443239 | GATGTAAATAGCTCAG | N/A | N/A | 3804 | 3819 | 71 |
| 1443240 | ACATATTAACCACCAG | 1134 | 1149 | 14828 | 14843 | 188 |
| 1443241 | TTCTGATAGTTACTAC | 915 | 930 | 14609 | 14624 | 110 |
| 1443242 | CCACGAATTGTCAGCT | 1510 | 1525 | 15204 | 15219 | 49 |
| 1443243 | CACATATTAACCACCA | 1135 | 1150 | 14829 | 14844 | 264 |
| 1443244 | GTATGAAGTCTTACGG | 76 | 91 | 3338 | 3353 | 167 |
| 1443245 | TCACATATTAACCACC | 1136 | 1151 | 14830 | 14845 | 39 |
| 1443252 | AATACATATAACACGC | 1610 | 1625 | 15304 | 15319 | 426 |
| 1443254 | CTTATTTGTAGTGAGC | N/A | N/A | 4542 | 4557 | 598 |
| 1443256 | ATAACAGATGTGAGGA | 879 | 894 | 14573 | 14588 | 1072 |
| 1443258 | GATGAATACATATGGT | 541 | 556 | 14235 | 14250 | 1262 |
| 1443260 | TAGAAATTTGTGAGCC | 648 | 663 | 14342 | 14357 | 1360 |
| 1443262 | GTCTAATTTGGAGAGG | N/A | N/A | 5416 | 5431 | 1051 |
| 1443263 | ACTAATGTCATATACC | N/A | N/A | 7563 | 7578 | 1344 |
| 1443265 | ATAGTAGTAGTTTCCA | N/A | N/A | 11993 | 12008 | 1243 |
| 1443267 | GGTAACAATAAGTTTT | 528 | 543 | 14222 | 14237 | 450 |
| 1443268 | CAGTATTTTTGGTGGT | N/A | N/A | 7284 | 7299 | 642 |
| 1443269 | GTGTAGAAATGCCAGA | N/A | N/A | 7862 | 7877 | 1294 |
| 1446691 | AGAGTATTGTGTTGTA | 89 | 104 | 3351 | 3366 | 1416 |
| 1446693 | TTACTTTGATACTTGG | 822 | 837 | 14516 | 14531 | 612 |
| 1446694 | AACATTTGTCATAGGA | N/A | N/A | 4517 | 4532 | 1415 |
| 1446697 | AGAAATTTGTGAGCCA | 647 | 662 | 14341 | 14356 | 1485 |
| 1446709 | AAGTCTTAAGGTTTCA | 1271 | 1286 | 14965 | 14980 | 1446 |
| 1446726 | TTGGATGTTAGGCTGG | 1316 | 1331 | 15010 | 15025 | 1410 |
| 1446731 | AGTATTTTTGGTGGTA | N/A | N/A | 7283 | 7298 | 1432 |
| 1446733 | ACAGATGTGAGGAGTC | 876 | 891 | 14570 | 14585 | 1407 |
| 1446734 | CCTTTTTTGGACTTGT | N/A | N/A | 6944 | 6959 | 1452 |
| 1446735 | GAAATTTGTGAGCCAT | 646 | 661 | 14340 | 14355 | 1486 |

The modified oligonucleotides in the table below are 16 nucleosides in length, wherein the sugar motif for the modified oligonucleotides is (from 5' to 3'): kkddddddddd-kekek; wherein each "d" represents a 2'-β-D-deoxyribosyl sugar moiety, each "e" represents a 2'-MOE sugar moiety, and each "k" represents a cEt modified sugar moiety. The modified oligonucleotides have an internucleoside linkage motif of (from 5' to 3'): sssssssssssssss; wherein each "s" represents a phosphorothioate internucleoside linkage. Each cytosine residue is a 5-methyl cytosine.

TABLE 48

6-palmitamidohexyl-conjugated modified oligonucleotides with a mixed MOE/cEt sugar motif and uniformPS internucleoside linkages complementary to human PLN

| Compound Number | Sequence (5′ to 3′) | SEQ ID No: 1 Start Site | SEQ ID No: 1 Stop Site | SEQ ID No: 2 Start Site | SEQ ID No: 2 Stop Site | SEQ ID NO. |
|---|---|---|---|---|---|---|
| 1436541 | AAGATATAGTATGGTA | 1247 | 1262 | 14941 | 14956 | 45 |
| 1443257 | ATAGTAGGCTATTAGG | 1545 | 1560 | 15239 | 15254 | 1223 |
| 1443261 | CAAAGATATAGTATGG | 1249 | 1264 | 14943 | 14958 | 942 |
| 1443264 | TATGTAAGAGTATGGC | 1017 | 1032 | 14711 | 14726 | 186 |
| 1446711 | GGATGTTAGGCTGGAA | 1314 | 1329 | 15008 | 15023 | 519 |
| 1446712 | TTATGGTCAATAGTAG | 1554 | 1569 | 15248 | 15263 | 1015 |
| 1446715 | AAAGATATAGTATGGT | 1248 | 1263 | 14942 | 14957 | 120 |
| 1446717 | TTGTGTTGTATGAAGT | 83 | 98 | 3345 | 3360 | 1530 |
| 1446729 | ACGAGTATATTAGGAA | N/A | N/A | 5499 | 5514 | 737 |
| 1446736 | CTTTGATACTTGGTGA | 819 | 834 | 14513 | 14528 | 184 |
| 1446737 | AGAGTATTGTGTTGTA | 89 | 104 | 3351 | 3366 | 1416 |
| 1446740 | AGATATAGTATGGTAA | 1246 | 1261 | 14940 | 14955 | 270 |

The modified oligonucleotides in the table below are 16 nucleosides in length, wherein the sugar motif for the modified oligonucleotides is (from 5' to 3'): kkkddddddddddkkke; wherein each "d" represents a 2'-β-D-deoxyribosyl sugar moiety, each "e" represents a 2'-MOE sugar moiety, and each "k" represents a cEt modified sugar moiety. The modified oligonucleotides have an internucleoside linkage motif of (from 5' to 3'): sssssssssssssss; wherein each "s" represents a phosphorothioate internucleoside linkage. Each cytosine residue is a 5-methyl cytosine.

TABLE 49

6-palmitamidohexyl-conjugated modified oligonucleotides with a mixed MOE/cEt sugar motif and uniform PS internucleoside linkages complementary to human PLN

| Compound Number | Sequence (5′ to 3′) | SEQ ID No: 1 Start Site | SEQ ID No: 1 Stop Site | SEQ ID No: 2 Start Site | SEQ ID No: 2 Stop Site | SEQ ID NO. |
|---|---|---|---|---|---|---|
| 1443253 | AAGATATAGTATGGTA | 1247 | 1262 | 14941 | 14956 | 45 |
| 1443255 | CAAAGATATAGTATGG | 1249 | 1264 | 14943 | 14958 | 942 |
| 1443259 | GATATAGTATGGTAAG | 1245 | 1260 | 14939 | 14954 | 1046 |
| 1443270 | CACATATTAACCACCA | 1135 | 1150 | 14829 | 14844 | 264 |
| 1446696 | CCTTTTTTGGACTTGT | N/A | N/A | 6944 | 6959 | 1452 |
| 1446698 | ATGTTTACAAGATCCA | 560 | 575 | 14254 | 14269 | 700 |
| 1446699 | AGATGTAATAGATGGG | 1463 | 1478 | 15157 | 15172 | 1106 |
| 1446701 | ACGAGTATATTAGGAA | N/A | N/A | 5499 | 5514 | 737 |
| 1446703 | TAGATGTAATAGATGG | 1464 | 1479 | 15158 | 15173 | 1077 |
| 1446705 | GGAAATCAACAGTTGC | 625 | 640 | 14319 | 14334 | 564 |
| 1446716 | TAGTTAAGATTTTGCG | 1529 | 1544 | 15223 | 15238 | 819 |
| 1446718 | GTAGTTAAGATTTTGC | 1530 | 1545 | 15224 | 15239 | 752 |
| 1446725 | AAAGATATAGTATGGT | 1248 | 1263 | 14942 | 14957 | 120 |

TABLE 49-continued 6-palmitamidohexyl-conjugated modified oligonucleotides with a mixed MOE/cEt sugar motif and uniform PS internucleoside linkages complementary to human PLN

| Compound Number | Sequence (5′ to 3′) | SEQ ID No: 1 Start Site | SEQ ID No: 1 Stop Site | SEQ ID No: 2 Start Site | SEQ ID No: 2 Stop Site | SEQ ID NO. |
|---|---|---|---|---|---|---|
| 1446727 | TTACTTTGATACTTGG | 822 | 837 | 14516 | 14531 | 612 |
| 1446728 | TAAGGTTTCATGATTC | 1265 | 1280 | 14959 | 14974 | 615 |
| 1446730 | CACGAGTATATTAGGA | N/A | N/A | 5500 | 5515 | 675 |
| 1446738 | GTATTTTTGGTGGTAT | N/A | N/A | 7282 | 7297 | 1431 |

The modified oligonucleotides in the table below are 16 nucleosides in length, wherein the sugar motif for the modified oligonucleotides is (from 5' to 3'): kkkdyddddddddkkk; wherein each "d" represents a 2'-β-D-deoxyribosyl sugar moiety, each "y" represents a 2'-OMe sugar moiety, and each "k" represents a cEt modified sugar moiety. The modified oligonucleotides have an internucleoside linkage motif of (from 5' to 3'): sssssssssssssss; wherein each "s" represents a phosphorothioate internucleoside linkage. Each cytosine residue is a 5-methyl cytosine.

TABLE 50

6-palmitamidohexyl-conjugated modified oligonucleotides with a mixed cEt/2′-OMe sugar motif and uniform PS internucleoside linkages complementary to human PLN

| Compound Number | Sequence (5′ to 3′) | SEQ ID No: 1 Start Site | SEQ ID No: 1 Stop Site | SEQ ID No: 2 Start Site | SEQ ID No: 2 Stop Site | SEQ ID NO. |
|---|---|---|---|---|---|---|
| 1443266 | ACATATTAACCACCAG | 1134 | 1149 | 14828 | 14843 | 188 |
| 1446700 | GGAAATCAACAGTTGC | 625 | 640 | 14319 | 14334 | 564 |
| 1446704 | GGTAGTTAAGATTTTG | 1531 | 1546 | 15225 | 15240 | 689 |
| 1446707 | TTACUTTGATACTTGG | 822 | 837 | 14516 | 14531 | 1628 |
| 1446710 | CAGTATTTTTGGTGGT | N/A | N/A | 7284 | 7299 | 642 |
| 1446713 | GTAAGGTTTATGGTCA | 1561 | 1576 | 15255 | 15270 | 53 |
| 1446720 | AAGGUTTATGGTCAAT | 1559 | 1574 | 15253 | 15268 | 1647 |
| 1446721 | GATGUTGTATATGCTG | N/A | N/A | 7359 | 7374 | 1594 |
| 1446723 | AGAAATTTGTGAGCCA | 647 | 662 | 14341 | 14356 | 1485 |
| 1446724 | TTGGATGTTAGGCTGG | 1316 | 1331 | 15010 | 15025 | 1410 |
| 1446741 | TAGAAATTTGTGAGCC | 648 | 663 | 14342 | 14357 | 1360 |

Example 10: Activity of Modified Oligonucleotides Complementary to Human PLN in Transgenic Mice, Single Dose Mice transgenic for human PLN carrying the R14del mutation (huPLN R14del transgenic mice) were generated using a CRISPR/CAS9 gene targeting system. Taconic Biosciences C57BL/6N Tac ES cell line was co-transfected with a plasmid allowing the expression of Cas9 mRNA, the specific gRNA and puromycin N-acetyl-transferase and with a plasmid containing the homology regions of the mouse Pln gene and the replaced human region including the R14del mutation (obtained from the mouse C57BL/6J RPCI-23 and human RPCI-11 BAC and/or CalTechD libraries, respectively). Mouse genomic sequence from exon 1 including the 5' untranslated region (UTR) to 29 bp downstream of exon 2 including the 3' UTR was replaced with its human counterpart. The human PLN gene is expressed under the control of the endogenous mouse Pln promoter.

Treatment

Transgenic mice were divided into groups of 2-3 mice each. Each mouse received subcutaneous injections of modified oligonucleotide at a dose of either 50 mg/kg or 100 mg/kg twice a week for either two or three weeks (either 3, 4 or 5 treatments), as indicated in the tables below. One group of four mice received subcutaneous injections of PBS twice a week for either two or three weeks (either 3, 4 or 5 treatments), as indicated in the tables below. The PBS-injected group served as the control group to which oligonucleotide-treated groups were compared.

RNA Analysis 72 hours post the final treatment, mice were sacrificed and RNA was extracted from mouse heart, aorta and/or quadriceps muscle as indicated for real-time RTPCR analysis of PLN RNA expression. Human PLN primer probe set Hs00160179_m1 (Integrated DNA Technologies) was used to measure human PLN RNA levels as indicated in the tables below. PLN RNA levels were normalized either to total RNA content, as measured by RIBOGREEN®, or to mouse GAPDH as indicated in the tables below. Mouse GAPDH was amplified using mouse primer probe set mGapdh_LTS00102 (forward sequence GGCAAATTCAACGGCACAGT, designated herein as SEQ ID NO: 9; reverse sequence GGGTCTCGCTCCTGGAAGAT, designated herein as SEQ ID NO: 10; probe sequence AAGGCCGAGAATGGGAAGCTTGTCATC, designated herein as SEQ ID NO: 11). Results are presented as percent PLN RNA, relative to PBS control (% control).

TABLE 51

Reduction of human PLN in transgenic mice, 50 mpk, 4 doses, normalized to Ribogreen

| Compound No. | PLN RNA (% control) Heart (Hs00160179_m1) | Aorta (Hs00160179_m1) |
|---|---|---|
| PBS | 100 | 100 |
| 1436539 | 33 | 37 |
| 1436540 | 66 | 69 |
| 1436541 | 44 | 33 |
| 1436542 | 20 | 22 |
| 1436543 | 29 | 44 |
| 1436544 | 41 | 43 |
| 1436545 | 69 | 96 |
| 1436546 | 35 | 25 |

TABLE 52

Reduction of human PLN in transgenic mice, 50 mpk, 3 doses, normalized to GAPDH

| Compound No. | PLN RNA (% control) Heart (Hs00160179_m1) |
|---|---|
| PBS | 100 |
| 1343077 | 72 |
| 1436542 | 26 |
| 1443233 | 65 |
| 1443234 | 52 |
| 1443235 | 46 |
| 1443236 | 81 |
| 1443237 | 78 |
| 1443238 | 49 |
| 1443239 | 44 |
| 1443240 | 34 |
| 1443241 | 40 |

TABLE 52-continued

Reduction of human PLN in transgenic mice, 50 mpk, 3 doses, normalized to GAPDH

| Compound No. | PLN RNA (% control) Heart (Hs00160179_m1) |
|---|---|
| 1443242 | 79 |
| 1443243 | 43 |
| 1443244 | 63 |
| 1443245 | 37 |
| 1443252 | 47 |
| 1443253 | 38 |
| 1443254 | 46 |

TABLE 53

Reduction of human PLN in transgenic mice, 50 mpk, 3 doses, normalized to GAPDH

| Compound No. | PLN RNA (% control) Heart (Hs00160179_m1) |
|---|---|
| PBS | 100 |
| 1436542 | 28 |
| 1443255 | 64 |
| 1443256 | 61 |
| 1443257 | 36 |
| 1443258 | 52 |
| 1443259 | 65 |
| 1443260 | 40 |
| 1443261 | 48 |
| 1443262 | 56 |
| 1443263 | 62 |
| 1443264 | 83 |
| 1443265 | 64 |
| 1443266 | 40 |
| 1443267 | 55 |
| 1443268 | 60 |
| 1443269 | 60 |

TABLE 54

Reduction of human PLN in transgenic mice, 50 mpk, 3 doses, normalized to GAPDH

| Compound No. | PLN RNA (% control) Heart (Hs00160179_m1) |
|---|---|
| PBS | 100 |
| 1436542 | 24 |
| 1446697 | 8 |
| 1446698 | 20 |
| 1446701 | 27 |
| 1446700 | 29 |
| 1446694 | 30 |
| 1446696 | 31 |
| 1446703 | 33 |
| 1446693 | 33 |
| 1446691 | 33 |
| 1446705 | 37 |
| 1446704 | 48 |
| 1446699 | 54 |

TABLE 55

Reduction of human PLN in transgenic mice, 50 mpk, 3 doses, normalized to GAPDH

| Compound No. | PLN RNA (% control) Heart (Hs00160179_m1) |
|---|---|
| PBS | 100 |
| 1436542 | 25 |

TABLE 55-continued

| Reduction of human PLN in transgenic mice, 50 mpk, 3 doses, normalized to GAPDH | |
|---|---|
| Compound No. | PLN RNA (% control) Heart (Hs00160179_m1) |
| 1446723 | 13 |
| 1446721 | 21 |
| 1446715 | 37 |
| 1446707 | 34 |
| 1446712 | 38 |
| 1446709 | 42 |
| 1446713 | 33 |
| 1446711 | 41 |
| 1446716 | 48 |
| 1446717 | 46 |
| 1446718 | 54 |
| 1446720 | 59 |
| 1446710 | 70 |

TABLE 56

| Reduction of human PLN in transgenic mice, 50 mpk, 3 doses, normalized to GAPDH | |
|---|---|
| Compound No. | PLN RNA (% control) Heart (Hs00160179_m1) |
| PBS | 100 |
| 1436542 | 28 |
| 1446729 | 22 |
| 1446724 | 44 |
| 1446728 | 44 |
| 1446726 | 37 |
| 1446740 | 53 |
| 1443270 | 32 |
| 1446727 | 43 |
| 1446730 | 28 |
| 1446741 | 36 |
| 1446725 | 50 |
| 1446735 | 42 |
| 1446731 | 39 |
| 1446734 | 41 |
| 1446737 | 40 |
| 1446736 | 50 |
| 1446733 | 63 |
| 1446738 | 46 |

TABLE 57

| Reduction of human PLN in transgenic mice, 100 mpk, 5 doses, normalized to Ribogreen | |
|---|---|
| Compound No. | PLN RNA (% control) Heart Hs00160179_m1 |
| PBS | 100 |
| 1121400 | 53 |
| 1121403 | 60 |
| 1121415 | 61 |
| 1342341 | 42 |
| 1342787 | 33 |
| 1342911 | 46 |
| 1343077 | 32 |
| 1343467 | 58 |
| 1343475 | 46 |
| 1343574 | 58 |
| 1343648 | 47 |
| 1343651 | 62 |
| 1393575 | 65 |
| 1393581 | 60 |
| 1393675 | 58 |
| 1393772 | 67 |
| 1393958 | 52 |

Example 11: Activity of Modified Oligonucleotides Complementary to Human PLN in Transgenic Mice, Multiple Dose huPLN R14del transgenic mice (described herein above) were used to determine activity of modified oligonucleotides complementary to human PLN.

Treatment

Transgenic mice were divided into groups of 3 mice each. Each mouse received subcutaneous injections of modified oligonucleotide at a dose indicated in the tables below twice a week for either two or three weeks (either 3, or 6 treatments respectively), as indicated in the tables below. One group of four mice received subcutaneous injections of PBS twice a week for either two or three weeks (either 3, or 6 treatments respectively), as indicated in the tables below. The PBS-injected group served as the control group to which oligonucleotide-treated groups were compared.

RNA Analysis 72 hours post the final treatment, mice were sacrificed and RNA was extracted from mouse hearts for real-time RTPCR analysis of PLN RNA expression. Human PLN primer probe sets Hs 160179_m1 (Integrated DNA Technologies) and/or RTS40402 (described herein above) were used to measure human PLN RNA levels. PLN RNA levels were normalized to total RNA content, as measured by RIBOGREEN. Results are presented as percent PLN RNA, relative to PBS control (% control). In some cases, a data point was not available and such cases are marked with an ‘N/A’ (Not Available). ED50s were calculated in Prism using nonlinear fit with variable slope (four parameter), top constrained to 100% (or 1), bottom constrained to 0. Y=Bottom+(Top−Bottom)/(1+(IC50/X)^HillSlope).

TABLE 58

Reduction of human PLN in transgenic mice, 3 doses, normalized to Ribogreen

| | | Heart (Hs00160179_m1) | | Heart (RTS40402) | |
|---|---|---|---|---|---|
| Compound No. | Dose (mpk) | PLN RNA (% control) | ED50 (mpk) | PLN RNA (% control) | ED50 (mpk) |
| PBS | 0 | 100 | — | 100 | — |
| 1436539 | 12.5 | 95 | 50 | 97 | 46 |
| | 25 | 82 | | 82 | |
| | 50 | 50 | | 45 | |
| 1436542 | 12.5 | 95 | 35 | 91 | 39 |
| | 25 | 62 | | 66 | |
| | 50 | 35 | | 40 | |
| 1436543 | 12.5 | 96 | 49 | 96 | 52 |
| | 25 | 80 | | 80 | |
| | 50 | 49 | | 52 | |
| 1443235 | 12.5 | 85 | 36 | 85 | 36 |
| | 25 | 59 | | 59 | |
| | 50 | 40 | | 40 | |
| 1443261 | 12.5 | 106 | 58 | 113 | 57 |
| | 25 | 90 | | 98 | |
| | 50 | 61 | | 65 | |

TABLE 59

| Reduction of human PLN in transgenic mice, 3 doses, normalized to Ribogreen | | | | | |
|---|---|---|---|---|---|
| | | Heart (Hs00160179_m1) | | Heart (RTS40402) | |
| Compound No. | Dose (mpk) | PLN RNA (% control) | ED50 (mpk) | PLN RNA (% control) | ED50 (mpk) |
| PBS | 0 | 100 | — | 100 | — |
| 1436541 | 50 | N/A | 31 | N/A | 29 |
| | 25 | 66 | | 61 | |
| | 12.5 | 95 | | 91 | |
| 1443253 | 50 | 46 | 46 | 42 | 42 |
| | 25 | 78 | | 74 | |
| | 12.5 | 101 | | 95 | |
| 1446715 | 50 | 48 | 46 | 46 | 44 |
| | 25 | 75 | | 69 | |
| | 12.5 | 99 | | 89 | |
| 1446725 | 50 | 52 | 50 | 48 | 47 |
| | 25 | 72 | | 73 | |
| | 12.5 | 95 | | 93 | |
| 1446730 | 50 | 39 | 42 | 38 | 39 |
| | 25 | 77 | | 72 | |
| | 12.5 | 93 | | 90 | |
| 1446740 | 50 | 60 | 57 | 59 | 56 |
| | 25 | 94 | | 92 | |
| | 12.5 | 95 | | 101 | |

TABLE 60

| Reduction of human PLN in transgenic mice, 6 doses, normalized to Ribogreen | | | |
|---|---|---|---|
| | | Heart (Hs00160179_m1) | |
| Compound No. | Dose (mpk) | PLN RNA (% control) | ED50 (mpk) |
| PBS | 0 | 100 | |
| 1343077 | 150 | 46 | 116 |
| | 100 | 51 | |
| | 50 | 66 | |
| 1436542 | 80 | 6 | 14 |
| | 40 | 16 | |
| | 20 | 32 | |
| | 10 | 68 | |
| 1393581 | 150 | 62 | 268 |
| | 100 | 78 | |
| | 50 | 83 | |
| 1446715 | 80 | 25 | 47 |
| | 40 | 56 | |
| | 20 | 87 | |
| | 10 | 96 | |
| 1393675 | 150 | 46 | 144 |
| | 100 | 62 | |
| | 50 | 63 | |
| 1446730 | 80 | 10 | 19 |
| | 40 | 22 | |
| | 20 | 46 | |
| | 10 | 75 | |
| 1342911 | 150 | 36 | 64 |
| | 100 | 31 | |
| | 50 | 60 | |
| 1436543 | 80 | 20 | 27 |
| | 40 | 25 | |
| | 20 | 65 | |
| | 10 | 87 | |

TABLE 61

| Reduction of human PLN in transgenic mice, 6 doses, normalized to Ribogreen | | | |
|---|---|---|---|
| | | Heart (Hs00160179_m1) | |
| Compound No. | Dose (mpk) | PLN RNA (% control) | ED50 (mpk) |
| PBS | 0 | 100 | |
| 1343475 | 150 | 49 | 136 |
| | 100 | 55 | |
| | 50 | 74 | |
| 1436541 | 80 | 19 | 29 |
| | 40 | 38 | |
| | 20 | 57 | |
| | 10 | 91 | |
| 1393493 | 150 | 40 | 117 |
| | 100 | 60 | |
| | 50 | 74 | |
| 1446729 | 80 | 5 | 18 |
| | 40 | 17 | |
| | 20 | 40 | |
| | 10 | 81 | |
| 1121403 | 150 | 58 | 236 |
| | 100 | 65 | |
| | 50 | 76 | |
| 1443235 | 80 | 19 | 25 |
| | 40 | 39 | |
| | 20 | 61 | |
| | 10 | 67 | |

Example 12: Design of RNAi Compounds with Antisense RNAi Oligonucleotides Complementary to a Human PLN Nucleic Acid RNAi compounds comprising antisense RNAi oligonucleotides complementary to a human PLN nucleic acid and sense RNAi oligonucleotides complementary to the antisense RNAi oligonucleotides were designed as follows.

The RNAi compounds in the table below consist of an antisense RNAi oligonucleotide and a sense RNAi oligonucleotide. In each case the antisense RNAi oligonucleotide is 23 nucleosides in length; has a sugar motif (from 5' to 3') of: yfyfyyfyyffyfyfyfyyy, wherein each "y" represents a 2'-O-methylribosyl sugar, and each "f" represents a 2'-fluororibosyl sugar; and has an internucleoside linkage motif (from 5' to 3') of: ssooooooooooooooooooss, wherein each "o" represents a phosphodiester internucleoside linkage, and each "s" represents a phosphorothioate internucleoside linkage. The sense RNAi oligonucleotide in each case is 21 nucleosides in length; has a sugar motif (from 5' to 3') of: fyfyfyfyfyfyfyfyfyf, wherein each "y" represents a 2'-O-methylribosyl sugar, and each "f" represents a 2'-fluororibosyl sugar; and has an internucleoside linkage motif (from 5' to 3') of: ssoooooooooooooooooss, wherein each "o" represents a phosphodiester internucleoside linkage, and each "s" represents a phosphorothioate internucleoside linkage. Each antisense RNAi oligonucleotide is complementary to the target nucleic acid (PLN), and each sense RNAi oligonucleotide is complementary to the first of the 21 nucleosides of the antisense RNAi oligonucleotide (from 5' to 3') wherein the last two 3'-nucleosides of the antisense RNAi oligonucleotides are not paired with the sense RNAi oligonucleotide (air overhanging nucleosides).

"Start site" indicates the 5'-most nucleoside to which the antisense RNAi oligonucleotides is complementary in the human gene sequence. "Stop site" indicates the 3'-most nucleoside to which the antisense RNAi oligonucleotide is complementary in the human gene sequence. Each modified antisense RNAi oligonucleoside listed in the tables below is 100% complementary to SEQ ID NO: 1 (GENBANK Accession No. NM_002667.4), with the exception of Compound No. 1564340 which is 100% complementary to SEQ ID NO: 2 (GENBANK Accession No. NC_000006.12, truncated from nucleosides 118545001 to 118565000) from nucleosides 16694 to 16716.

TABLE 62

RNAi compounds targeting human PLN SEQ ID NO: 1

| Compound Number | Antisense ID | Antisense Sequence (5′ to 3′) | SEQ ID NO. | SEQ ID NO: 1 Antisense Start Site | SEQ ID NO: 1 Antisense Stop Site | Sense ID | Sense Sequence (5′ to 3′) | SEQ ID NO. |
|---|---|---|---|---|---|---|---|---|
| 1563877 | 1563889 | UCAUCACAGUAUAGAGUAUUGUG | 1713 | 94 | 116 | 1563885 | CAAUACUCUAUACUGUGAUGA | 2025 |
| 1563878 | 1563891 | GGUGUUUAGCUGGGGAGUUUUCU | 1714 | 54 | 76 | 1563883 | AAAACUCCCCAGCUAAACACC | 2026 |
| 1563874 | 1563886 | UCUGACUCUGUCACCCAGUUUAU | 1715 | 34 | 56 | 1563880 | AAACUGGGUGACAGAGUCAGA | 2027 |
| 1563875 | 1563887 | GGUAGCCUUGGCAGCUGUGAUCA | 1716 | 114 | 136 | 1563881 | AUCACAGCUGCCAAGGCUACC | 2028 |
| 1563876 | 1563890 | GUGUUGUAUGAAGUCUUACGGGU | 1717 | 74 | 96 | 1563882 | CCGUAAGACUUCAUACAACAC | 2029 |
| 1563879 | 1563888 | GAGAUAACUGUCUUCUUUUAGGU | 1718 | 134 | 156 | 1563884 | CUAAAAGAAGACAGUUAUCUC | 2030 |
| 1563894 | 1563905 | UUUCUCCAUGAUACCAGCAGGAC | 1719 | 214 | 236 | 1563900 | CCUGCUGGUAUCAUGGAGAAA | 2031 |
| 1563897 | 1563909 | AAAAGCUGGCAGCCAAAUAUGAG | 1720 | 154 | 176 | 1563903 | CAUAUUUGGCUGCCAGCUUUU | 2032 |
| 1563892 | 1563906 | AAGUGGUCGAGAGAAAGAUAAAA | 1721 | 174 | 196 | 1563899 | UUAUCUUUCUCUCGACCACUU | 2033 |
| 1563896 | 1563908 | GACAGGAAGUCUGAAGUUUUAAG | 1722 | 194 | 216 | 1563902 | UAAAACUUCAGACUUCCUGUC | 2034 |
| 1563893 | 1563907 | UUGAGGCUCUUCUUAUAGCUGAG | 1723 | 254 | 276 | 1563901 | CAGCUAUAAGAAGAGCCUCAA | 2035 |
| 1563895 | 1563904 | GAGCGAGUGAGGUAUUGGACUUU | 1724 | 234 | 256 | 1563898 | AGUCCAAUACCUCACUCGCUC | 2036 |
| 1563910 | 1563925 | UUGUUGAGGCAUUUCAAUGGUUG | 1725 | 274 | 296 | 1563919 | ACCAUUGAAAUGCCUCAACAA | 2037 |
| 1563915 | 1563926 | UUCUGUAGCUUUUGACGUGCUUG | 1726 | 294 | 316 | 1563920 | AGCACGUCAAAAGCUACAGAA | 2038 |
| 1563911 | 1563924 | UAGCAGAACUUCAGAGAAGCAUC | 1727 | 374 | 396 | 1563918 | UGCUUCUCUGAAGUUCUGCUA | 2039 |
| 1563913 | 1563922 | AUCACGAUGAUACAGAUCAGCAA | 1728 | 354 | 376 | 1563917 | GCUGAUCUGUAUCAUCGUGAU | 2040 |
| 1563914 | 1563927 | GACAGAAAUUGAUAAAUAGAUUC | 1729 | 314 | 336 | 1563921 | AUCUAUUUAUCAAUUUCUGUC | 2041 |
| 1563912 | 1563923 | CAAGAGACAUAUUAAGAUGAGAC | 1730 | 334 | 356 | 1563916 | CUCAUCUUAAUAUGUCUCUUG | 2042 |
| 1563928 | 1563945 | AGCUGCAGAUCUAGAGGUUGUAG | 1731 | 394 | 416 | 1563939 | ACAACCUCUAGAUCUGCAGCU | 2043 |
| 1563931 | 1563942 | CUGUUAUACAAUAUUGUUUUCCU | 1732 | 454 | 476 | 1563934 | GAAAACAAUAUUGUAUAACAG | 2044 |
| 1563933 | 1563940 | GAUUUUAAGCUGAUGUGGCAAGC | 1733 | 414 | 436 | 1563936 | UUGCCACAUCAGCUUAAAAUC | 2045 |
| 1563932 | 1563943 | CCUGUCUGCAUGGGAUGACAGAU | 1734 | 434 | 456 | 1563937 | CUGUCAUCCCAUGCAGACAGG | 2046 |

TABLE 62-continued

RNAi compounds targeting human PLN SEQ ID NO: 1

| Compound Number | Antisense ID | Antisense Sequence (5' to 3') | SEQ ID NO. | SEQ ID NO: 1 Antisense Start Site | SEQ ID NO: 1 Antisense Stop Site | Sense ID | Sense Sequence (5' to 3') | SEQ ID NO. |
|---|---|---|---|---|---|---|---|---|
| 1563930 | 1563941 | UCUUCUACUCAG GAAGUGGUCUG | 1735 | 474 | 496 | 1563935 | GACCACUUCCUG AGUAGAAGA | 2047 |
| 1563929 | 1563944 | UGACCUUUUCAC AAAGAAACUCU | 1736 | 494 | 516 | 1563938 | AGUUUCUUUGUG AAAAGGUCA | 2048 |
| 1563947 | 1563960 | AUCAACAGUUGC AUUUUAUACAC | 1737 | 614 | 636 | 1563954 | GUAUAAAAUGCA ACUGUUGAU | 2049 |
| 1563948 | 1563958 | CACUUAUUUUGA AGUUAAUUUUU | 1738 | 594 | 616 | 1563953 | AAAUUAACUUCA AAAUAAGUG | 2050 |
| 1563951 | 1563962 | AUAAGUUUUAGU CUUAAUCUUGA | 1739 | 514 | 536 | 1563956 | AAGAUUAAGACU AAAACUUAU | 2051 |
| 1563950 | 1563963 | CAUGUUUACAAG AUCCAACAGAU | 1740 | 554 | 576 | 1563957 | CUGUUGGAUCUU GUAAACAUG | 2052 |
| 1563946 | 1563959 | GAUGAAUACAUA UGGUAACAAUA | 1741 | 534 | 556 | 1563955 | UUGUUACCAUAU GUAUUCAUC | 2053 |
| 1563949 | 1563961 | UUUGAAAAUAAA GCCCUUUUCAU | 1742 | 574 | 596 | 1563952 | GAAAAGGGCUUU AUUUUCAAA | 2054 |
| 1563964 | 1563976 | ACUAAACUCUUC AUCUUCAGAAA | 1743 | 674 | 696 | 1563973 | UCUGAAGAUGAA GAGUUUAGU | 2055 |
| 1563965 | 1563977 | CAAAAGAGUAAA AAUAAUGCUUU | 1744 | 734 | 756 | 1563972 | AGCAUUAUUUUU ACUCUUUUG | 2056 |
| 1563969 | 1563980 | UUGUGAGCCAUG UUGAGGAAAUC | 1745 | 634 | 656 | 1563974 | UUUCCUCAACAU GGCUCACAA | 2057 |
| 1563967 | 1563975 | GUUGGCAGUGCA GUUUUAAAACU | 1746 | 694 | 716 | 1563970 | UUUUAAAACUGC ACUGCCAAC | 2058 |
| 1563966 | 1563979 | UUUAUAUAUGAA GUGAACUUGUU | 1747 | 714 | 736 | 1563971 | CAAGUUCACUUC AUAUAUAAA | 2059 |
| 1563968 | 1563981 | AAAAGAUUUGGG AUAGAAAUUUG | 1748 | 654 | 676 | 1563978 | AAUUUCUAUCCC AAAUCUUUU | 2060 |
| 1563985 | 1563996 | UACUUUGAUACU UGGUGAAGACC | 1749 | 814 | 836 | 1563988 | UCUUCACCAAGU AUCAAAGUA | 2061 |
| 1563983 | 1563994 | UGACACUUCAUU UGUGUUAUUAC | 1750 | 834 | 856 | 1563990 | AAUAACACAAAU GAAGUGUCA | 2062 |
| 1563982 | 1563997 | AAUAUAAAUUAU AUUCACCUCAA | 1751 | 754 | 776 | 1563991 | GAGGUGAAUAU AAUUUAUAUU | 2063 |
| 1563986 | 1563998 | ACCUGAAAAAUA CUUAGUAUUAA | 1752 | 794 | 816 | 1563993 | AAUACUAAGUAU UUUUCAGGU | 2064 |
| 1563987 | 1563999 | UAAAGAAGCUUU UACAUUGUAAU | 1753 | 774 | 796 | 1563992 | UACAAUGUAAAA GCUUCUUUA | 2065 |
| 1563984 | 1563995 | GUUAUUACUUUG AUACUUGGUGA | 1754 | 819 | 841 | 1563989 | ACCAAGUAUCAA AGUAAUAAC | 2066 |
| 1564003 | 1564015 | UGUAGAUUCUGA UAGUUACUACA | 1755 | 914 | 936 | 1564006 | UAGUAACUAUCA GAAUCUACA | 2067 |
| 1564000 | 1564012 | CAGUGGACUAUU UUGAAUAAUGA | 1756 | 854 | 876 | 1564009 | AUUAUUCAAAAU AGUCCACUG | 2068 |
| 1564005 | 1564017 | AGAUAACAGAUG UGAGGAGUCAG | 1757 | 874 | 896 | 1564010 | GACUCCUCACAU CUGUUAUCU | 2069 |
| 1564002 | 1564013 | AUACAAUUUCUG UUUUAGAAUGU | 1758 | 934 | 956 | 1564007 | AUUCUAAAACAG AAAUUGUAU | 2070 |

TABLE 62-continued

RNAi compounds targeting human PLN SEQ ID NO: 1

| Compound Number | Antisense ID | Antisense Sequence (5' to 3') | SEQ ID NO. | SEQ ID NO: 1 Antisense Start Site | SEQ ID NO: 1 Antisense Stop Site | Sense ID | Sense Sequence (5' to 3') | SEQ ID NO. |
|---|---|---|---|---|---|---|---|---|
| 1564004 | 1564016 | ACAAAUAGUUCU UUAUAAUAAGA | 1759 | 894 | 916 | 1564011 | UUAUUAUAAAG AACUAUUUGU | 2071 |
| 1564001 | 1564014 | GUUAAUGUGGCA UAGAAAAAAUA | 1760 | 954 | 976 | 1564008 | UUUUUUCUAUGC CACAUUAAC | 2072 |
| 1564021 | 1564029 | CUUACUUUUCCA UACUUGAUUCU | 1761 | 994 | 1016 | 1564025 | AAUCAAGUAUGG AAAAGUAAG | 2073 |
| 1564022 | 1564034 | UUAUUAUGUAAG AGUAUGGCCUU | 1762 | 1014 | 1036 | 1564028 | GGCCAUACUCUU ACAUAAUAA | 2074 |
| 1564018 | 1564030 | UCUCAUCAACUU UAAAAGAUGUU | 1763 | 974 | 996 | 1564026 | CAUCUUUUAAAG UUGAUGAGA | 2075 |
| 1564023 | 1564035 | CAUACUUGAUUC UCAUCAACUUU | 1764 | 984 | 1006 | 1564033 | AGUUGAUGAGA AUCAAGUAUG | 2076 |
| 1564020 | 1564031 | AAAAUUACUUAA AAGGAAUUUUA | 1765 | 1034 | 1056 | 1564024 | AAAUUCCUUUUA AGUAAUUUU | 2077 |
| 1564019 | 1564032 | GAAUUCUGUGAU UCUUUGAAAAA | 1766 | 1054 | 1076 | 1564027 | UUUCAAAGAAUC ACAGAAUUC | 2078 |
| 1564036 | 1564051 | UAUGUCUUAGAA CAGAUUUAUGA | 1767 | 1094 | 1116 | 1564045 | AUAAAUCUGUUC UAAGACAUA | 2079 |
| 1564038 | 1564047 | AUUAGUGAUAUG ACUAAUCUCAC | 1768 | 1154 | 1176 | 1564043 | GAGAUUAGUCAU AUCACUAAU | 2080 |
| 1564040 | 1564053 | CACUGUCACAUA UUAACCACCAG | 1769 | 1134 | 1156 | 1564048 | GGUGGUUAAUA UGUGACAGUG | 2081 |
| 1564037 | 1564050 | UUAGAUUCUGUU GUUAGUAUAUU | 1770 | 1174 | 1196 | 1564044 | UAUACUAACAAC AGAAUCUAA | 2082 |
| 1564039 | 1564049 | CAGUUCUCAUCU GUUGAUCAUAU | 1771 | 1114 | 1136 | 1564042 | AUGAUCAACAGA UGAGAACUG | 2083 |
| 1564041 | 1564052 | UGAUUUACCUAC AUGUACUAGAA | 1772 | 1074 | 1096 | 1564046 | CUAGUACAUGUA GGUAAAUCA | 2084 |
| 1564058 | 1564071 | UAGUAUGGUAAG CUAGGUAACUC | 1773 | 1234 | 1256 | 1564065 | GUUACCUAGCUU ACCAUACUA | 2085 |
| 1564054 | 1564067 | UACAGUGCCUUA AAUGAAGAUUA | 1774 | 1194 | 1216 | 1564063 | AUCUUCAUUUAA GGCACUGUA | 2086 |
| 1564059 | 1564070 | CUCUAGCUCAGA UAAUUCACUAC | 1775 | 1214 | 1236 | 1564064 | AGUGAAUUAUCU GAGCUAGAG | 2087 |
| 1564057 | 1564069 | GAUAUAGUAUGG UAAGCUAGGUA | 1776 | 1238 | 1260 | 1564061 | CCUAGCUUACCA UACUAUAUC | 2088 |
| 1564055 | 1564068 | UGAUUCCAAAGA UAUAGUAUGGU | 1777 | 1248 | 1270 | 1564062 | CAUACUAUAUCU UUGGAAUCA | 2089 |
| 1564056 | 1564066 | CCAAAGAUAUAG UAUGGUAAGCU | 1778 | 1243 | 1265 | 1564060 | CUUACCAUACUA UAUCUUUGG | 2090 |
| 1564074 | 1564081 | CUGCAUUGGAUG UUAGGCUGGAA | 1779 | 1314 | 1336 | 1564078 | CCAGCCUAACAU CCAAUGCAG | 2091 |
| 1564072 | 1564082 | GUUUCAUGAUUC CAAAGAUAUAG | 1780 | 1254 | 1276 | 1564077 | AUAUCUUUGGAA UCAUGAAAC | 2092 |
| 1564084 | 1564088 | AAAUCUUUUAUU UUCCUUGCCUG | 1781 | 1334 | 1356 | 1564086 | GGCAAGGAAAAU AAAAGAUUU | 2093 |
| 1564073 | 1564080 | GAAUGGAAGACA ACCUGCAAAAU | 1782 | 1294 | 1316 | 1564076 | UUUGCAGGUUGU CUUCCAUUC | 2094 |

TABLE 62-continued

RNAi compounds targeting human PLN SEQ ID NO: 1

| Compound Number | Antisense ID | Antisense Sequence (5' to 3') | SEQ ID NO. | SEQ ID NO: 1 Antisense Start Site | SEQ ID NO: 1 Antisense Stop Site | Sense ID | Sense Sequence (5' to 3') | SEQ ID NO. |
|---|---|---|---|---|---|---|---|---|
| 1564085 | 1564089 | AUAUAUUUUUCU GUCACUGGAAA | 1783 | 1354 | 1376 | 1564087 | UCCAGUGACAGA AAAAUAUAU | 2095 |
| 1564075 | 1564083 | AAUCAUUCUGAA GUCUUAAGGUU | 1784 | 1274 | 1296 | 1564079 | CCUUAAGACUUC AGAAUGAUU | 2096 |
| 1564090 | 1564104 | UUUAAAAAAUAC UUGAGAUAAUA | 1785 | 1374 | 1396 | 1564101 | UUAUCUCAAGUA UUUUUUAAA | 2097 |
| 1564093 | 1564105 | CUAAUAAUUAGU UAAUAUUUGGA | 1786 | 1414 | 1436 | 1564100 | CAAAUAUUAACU AAUUAUUAG | 2098 |
| 1564094 | 1564102 | GGAGAGAGAAUU CAUAUAUUUUU | 1787 | 1394 | 1416 | 1564097 | AAAUAUAUGAA UUCUCUCUCC | 2099 |
| 1564092 | 1564103 | AUGUAAUAGAUG GGCCAACAAGU | 1788 | 1454 | 1476 | 1564099 | UUGUUGGCCCAU CUAUUACAU | 2100 |
| 1564091 | 1564107 | UGUUCAAGGGUC AGCUGUAGAUG | 1789 | 1474 | 1496 | 1564096 | UCUACAGCUGAC CCUUGAACA | 2101 |
| 1564095 | 1564106 | AGUUCAUUUCAA AAUAUAAUCUA | 1790 | 1434 | 1456 | 1564098 | GAUUAUAUUUU GAAAUGAACU | 2102 |
| 1564113 | 1564122 | GUCAGCUCCCCU AACCCCCAUGU | 1791 | 1494 | 1516 | 1564118 | AUGGGGGUUAG GGGAGCUGAC | 2103 |
| 1564111 | 1564124 | UAGUUAAGAUUU UGCGGACCCAC | 1792 | 1522 | 1544 | 1564116 | GGGUCCGCAAAA UCUUAACUA | 2104 |
| 1564110 | 1564120 | AUUUACUGUUUA UGUUAUCAGUA | 1793 | 1574 | 1596 | 1564114 | CUGAUAACAUAA ACAGUAAAU | 2105 |
| 1564109 | 1564121 | GUAAGGUUUAUG GUCAAUAGUAG | 1794 | 1554 | 1576 | 1564115 | ACUAUUGACCAU AAACCUUAC | 2106 |
| 1564112 | 1564123 | UAGGCUAUUAGG UAGUUAAGAUU | 1795 | 1534 | 1556 | 1564119 | UCUUAACUACCU AAUAGCCUA | 2107 |
| 1564108 | 1564125 | AUUUUGCGGACC CACGAAUUGUC | 1796 | 1514 | 1536 | 1564117 | CAAUUCGUGGGU CCGCAAAAU | 2108 |
| 1564127 | 1564139 | UAUUUUCUCUUU CUUAUGAUUUU | 1797 | 1674 | 1696 | 1564134 | AAUCAUAAGAAA GAGAAAAUA | 2109 |
| 1564129 | 1564142 | UAGCUUACUUUA UUGUAGGAAUA | 1798 | 1634 | 1656 | 1564137 | UUCCUACAAUAA AGUAAGCUA | 2110 |
| 1564128 | 1564140 | CAUUUAAUGAAU AGUAAAUAUAU | 1799 | 1694 | 1716 | 1564132 | AUAUUUACUAUU CAUUAAAUG | 2111 |
| 1564131 | 1564138 | AACACGCAAAAU AUGUGUUAAUU | 1800 | 1594 | 1616 | 1564133 | UUAACACAUAUU UUGCGUGUU | 2112 |
| 1564130 | 1564141 | UUUCUAAAUAAC AUUUUCUCUAG | 1801 | 1654 | 1676 | 1564136 | AGAGAAAAUGU UAUUUAGAAA | 2113 |
| 1564126 | 1564143 | AUAUAGUGUAUA AUACAUAUAAC | 1802 | 1614 | 1636 | 1564135 | UAUAUGUAUUA UACACUAUAU | 2114 |
| 1564146 | 1564157 | CUCCUCUGCCUA CUCAAUGUGAA | 1803 | 1754 | 1776 | 1564152 | CACAUUGAGUAG GCAGAGGAG | 2115 |
| 1564145 | 1564159 | CCCCACACCCCUA AGACAAGACU | 1804 | 1814 | 1836 | 1564153 | UCUUGUCUUAGG GGUGUGGGG | 2116 |
| 1564147 | 1564158 | UCUUCCUCCCCA UCUUUCUCCUC | 1805 | 1774 | 1796 | 1564150 | GGAGAAAGAUG GGGAGGAAGA | 2117 |
| 1564149 | 1564160 | CUUUUAUGUUGA CCCACUUCCAU | 1806 | 1714 | 1736 | 1564155 | GGAAGUGGGUCA ACAUAAAAG | 2118 |

TABLE 62-continued

RNAi compounds targeting human PLN SEQ ID NO: 1

| Compound Number | Antisense ID | Antisense Sequence (5' to 3') | SEQ ID NO. | SEQ ID NO: 1 Antisense Start Site | SEQ ID NO: 1 Antisense Stop Site | Sense ID | Sense Sequence (5' to 3') | SEQ ID NO. |
|---|---|---|---|---|---|---|---|---|
| 1564148 | 1564161 | GAAGACAAUGAG AAUGAAGACUU | 1807 | 1734 | 1756 | 1564154 | GUCUUCAUUCUC AUUGUCUUC | 2119 |
| 1564144 | 1564156 | ACUGCAAGACCA ACGCCUUCUCU | 1808 | 1794 | 1816 | 1564151 | AGAAGGCGUUGG UCUUGCAGU | 2120 |
| 1564167 | 1564178 | UGAAUAUUCUUU CCCCCACUCCC | 1809 | 1834 | 1856 | 1564169 | GAGUGGGGGAA AGAAUAUUCA | 2121 |
| 1564162 | 1564174 | UGCAAGGGUCCA CUUAUACAUGA | 1810 | 1854 | 1876 | 1564170 | AUGUAUAAGUG GACCCUUGCA | 2122 |
| 1564166 | 1564175 | AUCCUAUUACAG UUGACCCUUGA | 1811 | 1894 | 1916 | 1564168 | AAGGGUCAACUG UAAUAGGAU | 2123 |
| 1564163 | 1564176 | AGAGGAAGAAAA AUAGCUAUAUC | 1812 | 1914 | 1936 | 1564172 | UAUAGCUAUUUU UCUUCCUCU | 2124 |
| 1564164 | 1564177 | AUGCUUACCAUU UGGUUGAUAGA | 1813 | 1934 | 1956 | 1564173 | UAUCAACCAAAU GGUAAGCAU | 2125 |
| 1564165 | 1564179 | UGAACAACAAGG GCUUGAAUUGC | 1814 | 1874 | 1896 | 1564171 | AAUUCAAGCCCU UGUUGUUCA | 2126 |
| 1564184 | 1564195 | AAAUUUAUUCAU CAAGAAAAUAA | 1815 | 2014 | 2036 | 1564188 | AUUUUCUUGAUG AAUAAAUUU | 2127 |
| 1564181 | 1564194 | UUAUUGGAAGAU GUUCUGAAAUG | 1816 | 2054 | 2076 | 1564189 | UUUCAGAACAUC UUCCAAUAA | 2128 |
| 1564180 | 1564192 | GGAUCUAUAAUU UAGCUCAGUAG | 1817 | 1974 | 1996 | 1564191 | ACUGAGCUAAAU UAUAGAUCC | 2129 |
| 1564183 | 1564193 | UAAUUAUAAAUA GCAUAGCUGGA | 1818 | 1994 | 2016 | 1564190 | CAGCUAUGCUAU UUAUAAUUA | 2130 |
| 1564182 | 1564197 | AUGGUCAGAGGA GAAAUUGAAAA | 1819 | 2034 | 2056 | 1564186 | UUCAAUUUCUCC UCUGACCAU | 2131 |
| 1564185 | 1564196 | UAGAGUGGACUG CAAAAUAGAUG | 1820 | 1954 | 1976 | 1564187 | UCUAUUUUGCAG UCCACUCUA | 2132 |
| 1564202 | 1564215 | UUACCAAAGUUU GGUGAAUAUAU | 1821 | 2114 | 2136 | 1564205 | AUAUUCACCAAA CUUUGGUAA | 2133 |
| 1564199 | 1564210 | GAUUAUGCAGUA UAGGUGUAAAC | 1822 | 2174 | 2196 | 1564204 | UUACACCUAUAC UGCAUAAUC | 2134 |
| 1564198 | 1564212 | UAUUUUCCAGCA CUCAAUUUUAC | 1823 | 2094 | 2116 | 1564209 | AAAAUUGAGUGC UGGAAAAUA | 2135 |
| 1564200 | 1564214 | AACUAUUUUAGA CUUAAUUUUAA | 1824 | 2154 | 2176 | 1564208 | AAAAUUAAGUCU AAAAUAGUU | 2136 |
| 1564201 | 1564211 | UAAACUUUAGUC AACUUAAAUUA | 1825 | 2134 | 2156 | 1564206 | AUUUAAGUUGAC UAAAGUUUA | 2137 |
| 1564203 | 1564213 | UACUUCAGUUGU UUUAUGAGUUA | 1826 | 2074 | 2096 | 1564207 | ACUCAUAAAACA ACUGAAGUA | 2138 |
| 1564216 | 1564228 | AACUGAAAUUAA AAUUGUUGGAU | 1827 | 2194 | 2216 | 1564222 | CCAACAAUUUUA AUUUCAGUU | 2139 |
| 1564221 | 1564229 | UAUAUUAGUAAC AUGUCUUCAAC | 1828 | 2214 | 2236 | 1564227 | UGAAGACAUGUU ACUAAUAUA | 2140 |
| 1564217 | 1564231 | UAGUAACCAUGU UUUAGAAGAUA | 1829 | 2274 | 2296 | 1564224 | UCUUCUAAAACA UGGUUACUA | 2141 |
| 1564220 | 1564233 | AUAUGGUUAAUU ACACAUCCUCU | 1830 | 2254 | 2276 | 1564223 | AGGAUGUGUAA UUAACCAUAU | 2142 |

TABLE 62-continued

RNAi compounds targeting human PLN SEQ ID NO: 1

| Compound Number | Antisense ID | Antisense Sequence (5' to 3') | SEQ ID NO. | SEQ ID NO: 1 Antisense Start Site | SEQ ID NO: 1 Antisense Stop Site | Sense ID | Sense Sequence (5' to 3') | SEQ ID NO. |
|---|---|---|---|---|---|---|---|---|
| 1564218 | 1564232 | AUUGAUGUUACA UAUUCUUUUAG | 1831 | 2294 | 2316 | 1564225 | AAAAGAAUAUG UAACAUCAAU | 2143 |
| 1564219 | 1564230 | UCUACUCUUUUA AUAAUAGUUAU | 1832 | 2234 | 2256 | 1564226 | AACUAUUAUUAA AAGAGUAGA | 2144 |
| 1564235 | 1564247 | UAUCCCUGAACC AAACACUUUCC | 1833 | 2414 | 2436 | 1564241 | AAAGUGUUUGG UUCAGGGAUA | 2145 |
| 1564237 | 1564248 | UCUCUCAUGGGU UCAGAAAAUUU | 1834 | 2374 | 2396 | 1564242 | AUUUUCUGAACC CAUGAGAGA | 2146 |
| 1564234 | 1564249 | UAUUGAGUUAGC AACACUUGUGU | 1835 | 2334 | 2356 | 1564244 | ACAAGUGUUGCU AACUCAAUA | 2147 |
| 1564238 | 1564250 | UGUAAGAAACCA AGGUCAAUAUU | 1836 | 2314 | 2336 | 1564243 | UAUUGACCUUGG UUUCUUACA | 2148 |
| 1564256 | 1564265 | GAAUUUCCAGCU UGUAGAUGAGG | 1837 | 2474 | 2496 | 1564261 | UCAUCUACAAGC UGGAAAUUC | 2149 |
| 1564236 | 1564246 | UUUAAUAGUGUC UCCUUCACUAU | 1838 | 2354 | 2376 | 1564240 | AGUGAAGGAGAC ACUAUUAAA | 2150 |
| 1564239 | 1564251 | UCCACUCCCCAU CUCUAGUAUCU | 1839 | 2394 | 2416 | 1564245 | AUACUAGAGAUG GGGAGUGGA | 2151 |
| 1564253 | 1564269 | ACUAAAACCAGU GAGGUGAGUGU | 1840 | 2534 | 2556 | 1564258 | ACUCACCUCACU GGUUUUAGU | 2152 |
| 1564257 | 1564268 | AGGCGUCACUUA AGAAAUCUCUG | 1841 | 2454 | 2476 | 1564263 | GAGAUUUCUUAA GUGACGCCU | 2153 |
| 1564254 | 1564267 | UGUAUCACCUGU UGUUUAUAAGC | 1842 | 2514 | 2536 | 1564259 | UUAUAAACAACA GGUGAUACA | 2154 |
| 1564252 | 1564266 | CUGCCCUUCUGU UCUUCAGAUAU | 1843 | 2434 | 2456 | 1564260 | AUCUGAAGAACA GAAGGGCAG | 2155 |
| 1564255 | 1564264 | AGCUUUCUACUU GUUUUUAGGAA | 1844 | 2494 | 2516 | 1564262 | CCUAAAAACAAG UAGAAAGCU | 2156 |
| 1564270 | 1564283 | ACUUUCUGUAUU GGUAAUUUACU | 1845 | 2554 | 2576 | 1564280 | UAAAUUACCAAU ACAGAAAGU | 2157 |
| 1564274 | 1564284 | AAUCAGUUCAAA UUUUCCACUUG | 1846 | 2594 | 2616 | 1564278 | AGUGGAAAAUU UGAACUGAUU | 2158 |
| 1564271 | 1564285 | AAAAUAUUGUAA CAAACAGUGUA | 1847 | 2634 | 2656 | 1564277 | CACUGUUUGUUA CAAUAUUUU | 2159 |
| 1564275 | 1564286 | GUUAUUUCUGUU UACUGAGAAAA | 1848 | 2654 | 2676 | 1564276 | UUCUCAGUAAAC AGAAAUAAC | 2160 |
| 1564272 | 1564282 | UUGUUUUUAAGA CUAGGGAUACU | 1849 | 2574 | 2596 | 1564279 | UAUCCCUAGUCU UAAAAACAA | 2161 |
| 1564273 | 1564287 | GUAAUCAAAGGA AUAUGACUAAU | 1850 | 2614 | 2636 | 1564281 | UAGUCAUAUUCC UUUGAUUAC | 2162 |
| 1564292 | 1564304 | AAUGAAGAACAA AAAAAUUAGUU | 1851 | 2674 | 2696 | 1564299 | CUAAUUUUUUUG UUCUUCAUU | 2163 |
| 1564293 | 1564305 | UAUGAUGAAGAA UAAUUAUUUAA | 1852 | 2774 | 2796 | 1564298 | AAAUAAUUAUUC UUCAUCAUA | 2164 |
| 1564288 | 1564300 | UAAAGAGUUUAU UCUACUUUAUA | 1853 | 2754 | 2776 | 1564294 | UAAAGUAGAAU AAACUCUUUA | 2165 |
| 1564291 | 1564302 | GAUUUUAAUUUC UAUCAAAGAAU | 1854 | 2694 | 2716 | 1564297 | UCUUUGAUAGAA AUUAAAAUC | 2166 |

TABLE 62-continued

RNAi compounds targeting human PLN SEQ ID NO: 1

| Compound Number | Antisense ID | Antisense Sequence (5' to 3') | SEQ ID NO. | SEQ ID NO: 1 Antisense Start Site | SEQ ID NO: 1 Antisense Stop Site | Sense ID | Sense Sequence (5' to 3') | SEQ ID NO. |
|---|---|---|---|---|---|---|---|---|
| 1564289 | 1564301 | AUAAUUUGAGUU AUAGUAUUCUG | 1855 | 2734 | 2756 | 1564296 | GAAUACUAUAAC UCAAAUUAU | 2167 |
| 1564290 | 1564303 | CUGUAAUCCUCA CAGAAUAAGAU | 1856 | 2714 | 2736 | 1564295 | CUUAUUCUGUGA GGAUUACAG | 2168 |
| 1564308 | 1564319 | AUUGUUUUUAGU GCCCUGUAAAU | 1857 | 2894 | 2916 | 1564316 | UUACAGGGCACU AAAAACAAU | 2169 |
| 1564310 | 1564320 | CUAUAGUAGAAC AUAUUUGAGCA | 1858 | 2854 | 2876 | 1564313 | CUCAAAUAUGUU CUACUAUAG | 2170 |
| 1564307 | 1564321 | AAUUAAGAUAAG AACUUAUUCUA | 1859 | 2874 | 2896 | 1564317 | GAAUAAGUUCUU AUCUUAAUU | 2171 |
| 1564311 | 1564323 | AUAUCUUAUUCU UUACACUUUAU | 1860 | 2794 | 2816 | 1564314 | AAAGUGUAAAG AAUAAGAUAU | 2172 |
| 1564309 | 1564318 | GCAUUUAGUAUA UUAAAUUUUAA | 1861 | 2834 | 2856 | 1564312 | AAAAUUUAAUA UACUAAAUGC | 2173 |
| 1564306 | 1564322 | UAAAAAUAAAUU GUUUUCUUAUA | 1862 | 2814 | 2836 | 1564315 | UAAGAAAACAAU UUAUUUUUA | 2174 |
| 1564328 | 1564336 | UUAAACAAAUAU AUAUUCUUAAC | 1863 | 2954 | 2976 | 1564332 | UAAGAAUAUAU AUUUGUUUAA | 2175 |
| 1564325 | 1564340 | UGAGUUUUCAAG AACAUUCAUUU | 1864 | N/A | N/A | 1564335 | AUGAAUGUUCUU GAAAACUCA | 2176 |
| 1564324 | 1564339 | AACCAAUUAAAA UAUAAAAGGCA | 1865 | 2934 | 2956 | 1564333 | CCUUUUAUAUUU UAAUUGGUU | 2177 |
| 1564329 | 1564341 | GCAACAUUAAGC AUUUUAAAAUU | 1866 | 2914 | 2936 | 1564334 | UUUUAAAAUGCU UAAUGUUGC | 2178 |
| 1564326 | 1564337 | ACAUUCAUUUUA AUAUAGUGAUU | 1867 | 2987 | 3009 | 1564330 | UCACUAUAUUAA AAUGAAUGU | 2179 |
| 1564327 | 1564338 | UAUAGUGAUUCU GAUUUGCAUUA | 1868 | 2974 | 2996 | 1564331 | AUGCAAAUCAGA AUCACUAUA | 2180 |
| 1576614 | 1576627 | AUAGAGUAUUGU GUUGUAUGAAG | 1869 | 84 | 106 | 1576620 | UCAUACAACACA AUACUCUAU | 2181 |
| 1576613 | 1576624 | GCAGCUGUGAUC AUCACAGUAUA | 1870 | 104 | 126 | 1576618 | UACUGUGAUGAU CACAGCUGC | 2182 |
| 1576616 | 1576629 | AAGUCUUACGGG UGUUUAGCUGG | 1871 | 64 | 86 | 1576622 | AGCUAAACACCC GUAAGACUU | 2183 |
| 1576617 | 1576628 | AGCCAAAUAUGA GAUAACUGUCU | 1872 | 144 | 166 | 1576623 | ACAGUUAUCUCA UAUUUGGCU | 2184 |
| 1576615 | 1576626 | UCUUCUUUUAGG UAGCCUUGGCA | 1873 | 124 | 146 | 1576619 | CCAAGGCUACCU AAAAGAAGA | 2185 |
| 1576612 | 1576625 | UGGGGAGUUUUC UGACUCUGUCA | 1874 | 44 | 66 | 1576621 | ACAGAGUCAGAA AACUCCCCA | 2186 |
| 1576632 | 1576643 | AUUUCAAUGGUU GAGGCUCUUCU | 1875 | 264 | 286 | 1576640 | AAGAGCCUCAAC CAUUGAAAU | 2187 |
| 1576634 | 1576645 | CUGAAGUUUUAA GUGGUCGAGAG | 1876 | 184 | 206 | 1576639 | CUCGACCACUUA AAACUUCAG | 2188 |
| 1576635 | 1576646 | AUACCAGCAGGA CAGGAAGUCUG | 1877 | 204 | 226 | 1576637 | GACUUCCUGUCC UGCUGGUAU | 2189 |
| 1576630 | 1576647 | GAGAAAGAUAAA AAGCUGGCAGC | 1878 | 164 | 186 | 1576636 | UGCCAGCUUUUU AUCUUUCUC | 2190 |

TABLE 62-continued

RNAi compounds targeting human PLN SEQ ID NO: 1

| Compound Number | Antisense ID | Antisense Sequence (5' to 3') | SEQ ID NO. | SEQ ID NO: 1 Antisense Start Site | SEQ ID NO: 1 Antisense Stop Site | Sense ID | Sense Sequence (5' to 3') | SEQ ID NO. |
|---|---|---|---|---|---|---|---|---|
| 1576633 | 1576644 | GGUAUUGGACUU UCUCCAUGAUA | 1879 | 224 | 246 | 1576638 | UCAUGGAGAAAG UCCAAUACC | 2191 |
| 1576631 | 1576642 | UCUUAUAGCUGA GCGAGUGAGGU | 1880 | 244 | 266 | 1576641 | CUCACUCGCUCA GCUAUAAGA | 2192 |
| 1576652 | 1576664 | AUUAAGAUGAGA CAGAAAUUGAU | 1881 | 324 | 346 | 1576659 | CAAUUUCUGUCU CAUCUUAAU | 2193 |
| 1576651 | 1576663 | UACAGAUCAGCA AGAGACAUAUU | 1882 | 344 | 366 | 1576654 | UAUGUCUCUUGC UGAUCUGUA | 2194 |
| 1576648 | 1576661 | UUUGACGUGCUU GUUGAGGCAUU | 1883 | 284 | 306 | 1576657 | UGCCUCAACAAG CACGUCAAA | 2195 |
| 1576649 | 1576660 | CUAGAGGUUGUA GCAGAACUUCA | 1884 | 384 | 406 | 1576656 | AAGUUCUGCUAC AACCUCUAG | 2196 |
| 1576650 | 1576662 | UCAGAGAAGCAU CACGAUGAUAC | 1885 | 364 | 386 | 1576655 | AUCAUCGUGAUG CUUCUCUGA | 2197 |
| 1576653 | 1576665 | GAUAAAUAGAUU CUGUAGCUUUU | 1886 | 304 | 326 | 1576658 | AAGCUACAGAAU CUAUUUAUC | 2198 |
| 1576667 | 1576678 | ACAAAGAAACUC UUCUACUCAGG | 1887 | 484 | 506 | 1576674 | UGAGUAGAAGA GUUUCUUUGU | 2199 |
| 1576666 | 1576677 | UGAUGUGGCAAG CUGCAGAUCUA | 1888 | 404 | 426 | 1576673 | GAUCUGCAGCUU GCCACAUCA | 2200 |
| 1576671 | 1576683 | GUCUUAAUCUUG ACCUUUUCACA | 1889 | 504 | 526 | 1576679 | UGAAAAGGUCAA GAUUAAGAC | 2201 |
| 1576669 | 1576681 | AUAUUGUUUUCC UGUCUGCAUGG | 1890 | 444 | 466 | 1576676 | AUGCAGACAGGA AAACAAUAU | 2202 |
| 1576668 | 1576680 | AGGAAGUGGUCU GUUAUACAAUA | 1891 | 464 | 486 | 1576672 | UUGUAUAACAGA CCACUUCCU | 2203 |
| 1576670 | 1576682 | UGGGAUGACAGA UUUUAAGCUGA | 1892 | 424 | 446 | 1576675 | AGCUUAAAAUCU GUCAUCCCA | 2204 |
| 1576684 | 1576697 | UAUGGUAACAAU AAGUUUUAGUC | 1893 | 524 | 546 | 1576693 | CUAAAACUUAUU GUUACCAUA | 2205 |
| 1576686 | 1576694 | GCAUUUUAUACA CUUAUUUUGAA | 1894 | 604 | 626 | 1576692 | CAAAAUAAGUGU AUAAAAUGC | 2206 |
| 1576689 | 1576701 | AGAUCCAACAGA UGAAUACAUAU | 1895 | 544 | 566 | 1576696 | AUGUAUUCAUCU GUUGGAUCU | 2207 |
| 1576688 | 1576700 | AAGCCCUUUUCA UGUUUACAAGA | 1896 | 564 | 586 | 1576695 | UUGUAAACAUGA AAAGGGCUU | 2208 |
| 1576687 | 1576699 | GAAGUUAAUUUU UGAAAAUAAAG | 1897 | 584 | 606 | 1576690 | UUAUUUUCAAAA AUUAACUUC | 2209 |
| 1576685 | 1576698 | UGUUGAGGAAAU CAACAGUUGCA | 1898 | 624 | 646 | 1576691 | CAACUGUUGAUU UCCUCAACA | 2210 |
| 1576705 | 1576716 | AAGUGAACUUGU UGGCAGUGCAG | 1899 | 704 | 726 | 1576708 | GCACUGCCAACA AGUUCACUU | 2211 |
| 1576706 | 1576719 | CAGUUUUAAAAC UAAACUCUUCA | 1900 | 684 | 706 | 1576713 | AAGAGUUUAGU UUUAAAACUG | 2212 |
| 1576704 | 1576714 | AAAAUAAUGCUU UAUAUAUGAAG | 1901 | 724 | 746 | 1576709 | UCAUAUAUAAAG CAUUAUUUU | 2213 |
| 1576703 | 1576717 | AUAUUCACCUCA AAAGAGUAAAA | 1902 | 744 | 766 | 1576711 | UUACUCUUUUGA GGUGAAUAU | 2214 |

TABLE 62-continued

RNAi compounds targeting human PLN SEQ ID NO: 1

| Compound Number | Antisense ID | Antisense Sequence (5′ to 3′) | SEQ ID NO. | SEQ ID NO: 1 Antisense Start Site | SEQ ID NO: 1 Antisense Stop Site | Sense ID | Sense Sequence (5′ to 3′) | SEQ ID NO. |
|---|---|---|---|---|---|---|---|---|
| 1576702 | 1576715 | GGAUAGAAAUUU GUGAGCCAUGU | 1903 | 644 | 666 | 1576710 | AUGGCUCACAAA UUUCUAUCC | 2215 |
| 1576707 | 1576718 | UCAUCUUCAGAA AAGAUUUGGGA | 1904 | 664 | 686 | 1576712 | CCAAAUCUUUUC UGAAGAUGA | 2216 |
| 1576725 | 1576737 | UACUUAGUAUUA AAGAAGCUUUU | 1905 | 784 | 806 | 1576730 | AAGCUUCUUUAA UACUAAGUA | 2217 |
| 1576723 | 1576734 | UUUUGAAUAAUG ACACUUCAUUU | 1906 | 844 | 866 | 1576726 | AUGAAGUGUCAU UAUUCAAAA | 2218 |
| 1576722 | 1576733 | UGUGAGGAGUCA GUGGACUAUUU | 1907 | 864 | 886 | 1576727 | AUAGUCCACUGA CUCCUCACA | 2219 |
| 1576724 | 1576736 | CUUGGUGAAGAC CUGAAAAAUAC | 1908 | 804 | 826 | 1576731 | AUUUUUCAGGUC UUCACCAAG | 2220 |
| 1576721 | 1576732 | CUUUAUAAUAAG AUAACAGAUGU | 1909 | 884 | 906 | 1576729 | AUCUGUUAUCUU AUUAUAAAG | 2221 |
| 1576720 | 1576735 | UUUACAUUGUAA UAUAAAUUAUA | 1910 | 764 | 786 | 1576728 | UAAUUUAUAUU ACAAUGUAAA | 2222 |
| 1576742 | 1576754 | CAUAGAAAAAAU ACAAUUUCUGU | 1911 | 944 | 966 | 1576749 | AGAAAUUGUAU UUUUUCUAUG | 2223 |
| 1576743 | 1576755 | UGUUUUAGAAUG UAGAUUCUGAU | 1912 | 924 | 946 | 1576748 | CAGAAUCUACAU UCUAAAACA | 2224 |
| 1576741 | 1576751 | UUUAAAAGAUGU UAAUGUGGCAU | 1913 | 964 | 986 | 1576744 | GCCACAUUAACA UCUUUUAAA | 2225 |
| 1576740 | 1576750 | AGAGUAUGGCCU UACUUUUCCAU | 1914 | 1004 | 1026 | 1576745 | GGAAAAGUAAG GCCAUACUCU | 2226 |
| 1576738 | 1576753 | GAUAGUUACUAC AAAUAGUUCUU | 1915 | 904 | 926 | 1576747 | GAACUAUUUGUA GUAACUAUC | 2227 |
| 1576739 | 1576752 | AAAAGGAAUUUU AUUAUGUAAGA | 1916 | 1024 | 1046 | 1576746 | UUACAUAAUAAA AUUCCUUUU | 2228 |
| 1576760 | 1576773 | AACAGAUUUAUG AUUUACCUACA | 1917 | 1084 | 1106 | 1576770 | UAGGUAAAUCAU AAAUCUGUU | 2229 |
| 1576759 | 1576771 | UAUUAACCACCA GUUCUCAUCUG | 1918 | 1124 | 1146 | 1576763 | GAUGAGAACUGG UGGUUAAUA | 2230 |
| 1576761 | 1576772 | AUUCUUUGAAAA AAUUACUUAAA | 1919 | 1044 | 1066 | 1576766 | UAAGUAAUUUU UUCAAAGAAU | 2231 |
| 1576758 | 1576767 | CUGUUGAUCAUA UGUCUUAGAAC | 1920 | 1104 | 1126 | 1576762 | UCUAAGACAUAU GAUCAACAG | 2232 |
| 1576757 | 1576769 | UGACUAAUCUCA CUGUCACAUAU | 1921 | 1144 | 1166 | 1576765 | AUGUGACAGUGA GAUUAGUCA | 2233 |
| 1576756 | 1576768 | ACAUGUACUAGA AUUCUGUGAUU | 1922 | 1064 | 1086 | 1576764 | UCACAGAAUUCU AGUACAUGU | 2234 |
| 1576777 | 1576786 | AAGUCUUAAGGU UUCAUGAUUCC | 1923 | 1264 | 1286 | 1576781 | AAUCAUGAAACC UUAAGACUU | 2235 |
| 1576778 | 1576791 | GAUAAUUCACUA CAGUGCCUUAA | 1924 | 1204 | 1226 | 1576785 | AAGGCACUGUAG UGAAUUAUC | 2236 |
| 1576779 | 1576790 | UAAAUGAAGAUU AGAUUCUGUUG | 1925 | 1184 | 1206 | 1576784 | ACAGAAUCUAAU CUUCAUUUA | 2237 |
| 1576776 | 1576787 | AGCUAGGUAACU CUAGCUCAGAU | 1926 | 1224 | 1246 | 1576780 | CUGAGCUAGAGU UACCUAGCU | 2238 |

TABLE 62-continued

RNAi compounds targeting human PLN SEQ ID NO: 1

| Compound Number | Antisense ID | Antisense Sequence (5' to 3') | SEQ ID NO. | SEQ ID NO: 1 Antisense Start Site | SEQ ID NO: 1 Antisense Stop Site | Sense ID | Sense Sequence (5' to 3') | SEQ ID NO. |
|---|---|---|---|---|---|---|---|---|
| 1576775 | 1576789 | UGCAAAAUCAUU CUGAAGUCUUA | 1927 | 1279 | 1301 | 1576782 | AGACUUCAGAAU GAUUUUGCA | 2239 |
| 1576774 | 1576788 | UUGUUAGUAUAU UAGUGAUAUGA | 1928 | 1164 | 1186 | 1576783 | AUAUCACUAAUA UACUAACAA | 2240 |
| 1576796 | 1576809 | UUUUCCUUGCCU GCAUUGGAUGU | 1929 | 1324 | 1346 | 1576806 | AUCCAAUGCAGG CAAGGAAAA | 2241 |
| 1576793 | 1576803 | UUCAUAUAUUUU UAAAAAAUACU | 1930 | 1384 | 1406 | 1576801 | UAUUUUUUAAA AAUAUAUGAA | 2242 |
| 1576797 | 1576808 | UGUUAGGCUGGA AUGGAAGACAA | 1931 | 1304 | 1326 | 1576802 | GUCUUCCAUUCC AGCCUAACA | 2243 |
| 1576792 | 1576804 | CAACCUGCAAAA UCAUUCUGAAG | 1932 | 1284 | 1306 | 1576800 | UCAGAAUGAUUU UGCAGGUUG | 2244 |
| 1576794 | 1576807 | ACUUGAGAUAAU AUAUUUUUCUG | 1933 | 1364 | 1386 | 1576799 | GAAAAAUAUAU UAUCUCAAGU | 2245 |
| 1576795 | 1576805 | CUGUCACUGGAA AUCUUUUAUUU | 1934 | 1344 | 1366 | 1576798 | AUAAAAGAUUUC CAGUGACAG | 2246 |
| 1576813 | 1576825 | UGGGCCAACAAG UUCAUUUCAAA | 1935 | 1444 | 1466 | 1576819 | UGAAAUGAACUU GUUGGCCCA | 2247 |
| 1576810 | 1576821 | GUUAAUAUUUGG AGAGAGAAUUC | 1936 | 1404 | 1426 | 1576817 | AUUCUCUCUCCA AAUAUUAAC | 2248 |
| 1576812 | 1576826 | CUAACCCCCAUG UUCAAGGGUCA | 1937 | 1484 | 1506 | 1576820 | ACCCUUGAACAU GGGGGUUAG | 2249 |
| 1576814 | 1576824 | AAAAUAUAAUCU AAUAAUUAGUU | 1938 | 1424 | 1446 | 1576818 | CUAAUUAUUAGA UUAUAUUUU | 2250 |
| 1576815 | 1576827 | GAAUUGUCAGCU CCCCUAACCCC | 1939 | 1499 | 1521 | 1576822 | GGUUAGGGGAGC UGACAAUUC | 2251 |
| 1576811 | 1576823 | UCAGCUGUAGAU GUAAUAGAUGG | 1940 | 1464 | 1486 | 1576816 | AUCUAUUACAUC UACAGCUGA | 2252 |
| 1576829 | 1576845 | UAAUACAUAUAA CACGCAAAAUA | 1941 | 1604 | 1626 | 1576838 | UUUUGCGUGUUA UAUGUAUUA | 2253 |
| 1576830 | 1576840 | AUAUGUGUUAAU UUACUGUUUAU | 1942 | 1584 | 1606 | 1576837 | AAACAGUAAAUU AACACAUAU | 2254 |
| 1576828 | 1576842 | UAUUGUAGGAAU AUAGUGUAUAA | 1943 | 1624 | 1646 | 1576839 | AUACACUAUAUU CCUACAAUA | 2255 |
| 1576831 | 1576844 | UAUGUUAUCAGU AAGGUUUAUGG | 1944 | 1564 | 1586 | 1576834 | AUAAACCUUACU GAUAACAUA | 2256 |
| 1576833 | 1576841 | CCCACGAAUUGU CAGCUCCCCUA | 1945 | 1504 | 1526 | 1576836 | GGGGAGCUGACA AUUCGUGGG | 2257 |
| 1576832 | 1576843 | UGGUCAAUAGUA GGCUAUUAGGU | 1946 | 1544 | 1566 | 1576835 | CUAAUAGCCUAC UAUUGACCA | 2258 |
| 1576848 | 1576859 | AGAAUGAAGACU UUUAUGUUGAC | 1947 | 1724 | 1746 | 1576853 | CAACAUAAAAGU CUUCAUUCU | 2259 |
| 1576850 | 1576863 | AUAGUAAAUAUA UUUUCUCUUUC | 1948 | 1684 | 1706 | 1576860 | AAGAGAAAAUA UAUUUACUAU | 2260 |
| 1576851 | 1576862 | UUCUUAUGAUUU UCUAAAUAACA | 1949 | 1664 | 1686 | 1576856 | UUAUUUAGAAA AUCAUAAGAA | 2261 |
| 1576849 | 1576857 | GACCCACUUCCA UUUAAUGAAUA | 1950 | 1704 | 1726 | 1576852 | UUCAUUAAAUGG AAGUGGGUC | 2262 |

TABLE 62-continued

RNAi compounds targeting human PLN SEQ ID NO: 1

| Compound Number | Antisense ID | Antisense Sequence (5' to 3') | SEQ ID NO. | SEQ ID NO: 1 Antisense Start Site | SEQ ID NO: 1 Antisense Stop Site | Sense ID | Sense Sequence (5' to 3') | SEQ ID NO. |
|---|---|---|---|---|---|---|---|---|
| 1576847 | 1576858 | UACUCAAUGUGA AGACAAUGAGA | 1951 | 1744 | 1766 | 1576854 | UCAUUGUCUUCA CAUUGAGUA | 2263 |
| 1576846 | 1576861 | ACAUUUUCUCUA GCUUACUUUAU | 1952 | 1644 | 1666 | 1576855 | AAAGUAAGCUAG AGAAAAUGU | 2264 |
| 1576869 | 1576881 | GGGCUUGAAUUG CAAGGGUCCAC | 1953 | 1864 | 1886 | 1576876 | GGACCCUUGCAA UUCAAGCCC | 2265 |
| 1576868 | 1576879 | CAUCUUUCUCCU CCUCUGCCUAC | 1954 | 1764 | 1786 | 1576873 | AGGCAGAGGAGG AGAAAGAUG | 2266 |
| 1576864 | 1576877 | CUAAGACAAGAC UGCAAGACCAA | 1955 | 1804 | 1826 | 1576871 | GGUCUUGCAGUC UUGUCUUAG | 2267 |
| 1576865 | 1576875 | UUCCCCCACUCCC CACACCCCUA | 1956 | 1824 | 1846 | 1576872 | GGGGUGUGGGG AGUGGGGGAA | 2268 |
| 1576866 | 1576874 | CACUUAUACAUG AAUAUUCUUUC | 1957 | 1844 | 1866 | 1576870 | AAGAAUAUUCAU GUAUAAGUG | 2269 |
| 1576867 | 1576880 | CAACGCCUUCUC UUCCUCCCCAU | 1958 | 1784 | 1806 | 1576878 | GGGGAGGAAGA GAAGGCGUUG | 2270 |
| 1576882 | 1576895 | AGUUGACCCUUG AACAACAAGGG | .959 | 1884 | 1906 | 1576889 | CUUGUUGUUCAA GGGUCAACU | 2271 |
| 1576884 | 1576894 | UUUAGCUCAGUA GAGUGGACUGC | 1960 | 1964 | 1986 | 1576888 | AGUCCACUCUAC UGAGCUAAA | 2272 |
| 1576883 | 1576896 | UAGCAUAGCUGG AUCUAUAAUUU | 1961 | 1984 | 2006 | 1576890 | AUUAUAGAUCCA GCUAUGCUA | 2273 |
| 1576887 | 1576897 | AAAUAGCUAUAU CCUAUUACAGU | 1962 | 1904 | 1926 | 1576891 | UGUAAUAGGAU AUAGCUAUUU | 2274 |
| 1576885 | 1576899 | UUUGGUUGAUAG AGGAAGAAAAA | 1963 | 1924 | 1946 | 1576892 | UUUCUUCCUCUA UCAACCAAA | 2275 |
| 1576886 | 1576898 | UGCAAAAUAGAU GCUUACCAUUU | 1964 | 1944 | 1966 | 1576893 | AUGGUAAGCAUC UAUUUUGCA | 2276 |
| 1576901 | 1576912 | CACUCAAUUUUA CUUCAGUUGUU | 1965 | 2084 | 2106 | 1576909 | CAACUGAAGUAA AAUUGAGUG | 2277 |
| 1576903 | 1576913 | AUGUUCUGAAAU GGUCAGAGGAG | 1966 | 2044 | 2066 | 1576907 | CCUCUGACCAUU UCAGAACAU | 2278 |
| 1576902 | 1576911 | GUUUUAUGAGUU AUUGGAAGAUG | 1967 | 2064 | 2086 | 1576906 | UCUUCCAAUAAC UCAUAAAAC | 2279 |
| 1576900 | 1576915 | AUCAAGAAAAUA AUUAUAAAUAG | 1968 | 2004 | 2026 | 1576908 | AUUUAUAAUUA UUUUCUUGAU | 2280 |
| 1576905 | 1576916 | AUUGAAAAUUUA UUCAUCAAGAA | 1969 | 2019 | 2041 | 1576910 | CUUGAUGAAUAA AUUUUCAAU | 2281 |
| 1576904 | 1576917 | GAGAAAUUGAAA AUUUAUUCAUC | 1970 | 2024 | 2046 | 1576914 | UGAAUAAAUUU UCAAUUUCUC | 2282 |
| 1576919 | 1576933 | ACAUGUCUUCAA CUGAAAUUAAA | 1971 | 2204 | 2226 | 1576926 | UAAUUUCAGUUG AAGACAUGU | 2283 |
| 1576920 | 1576929 | AAAAUUGUUGGA UUAUGCAGUAU | 1972 | 2184 | 2206 | 1576925 | ACUGCAUAAUCC AACAAUUUU | 2284 |
| 1576923 | 1576934 | UCAACUUAAAUU ACCAAAGUUUG | 1973 | 2124 | 2146 | 1576928 | AACUUUGGUAAU UUAAGUUGA | 2285 |
| 1576922 | 1576935 | GACUUAAUUUUA AACUUUAGUCA | 1974 | 2144 | 2166 | 1576931 | ACUAAAGUUUAA AAUUAAGUC | 2286 |

TABLE 62-continued

RNAi compounds targeting human PLN SEQ ID NO: 1

| Compound Number | Antisense ID | Antisense Sequence (5' to 3') | SEQ ID NO. | SEQ ID NO: 1 Antisense Start Site | SEQ ID NO: 1 Antisense Stop Site | Sense ID | Sense Sequence (5' to 3') | SEQ ID NO. |
|---|---|---|---|---|---|---|---|---|
| 1576921 | 1576930 | UAUAGGUGUAAA CUAUUUUAGAC | 1975 | 2164 | 2186 | 1576924 | CUAAAAUAGUUU ACACCUAUA | 2287 |
| 1576918 | 1576932 | UUGGUGAAUAUA UUUUCCAGCAC | 1976 | 2104 | 2126 | 1576927 | GCUGGAAAAUAU AUUCACCAA | 2288 |
| 1576937 | 1576950 | CAAGGUCAAUAU UGAUGUUACAU | 1977 | 2304 | 2326 | 1576945 | GUAACAUCAAUA UUGACCUUG | 2289 |
| 1576938 | 1576947 | CAUAUUCUUUUA GUAACCAUGUU | 1978 | 2284 | 2306 | 1576943 | CAUGGUUACUAA AAGAAUAUG | 2290 |
| 1576939 | 1576949 | GUUUUAGAAGAU AUGGUUAAUUA | 1979 | 2264 | 2286 | 1576942 | AUUAACCAUAUC UUCUAAAAC | 2291 |
| 1576936 | 1576951 | AUAGUUAUAUUA GUAACAUGUCU | 1980 | 2219 | 2241 | 1576944 | ACAUGUUACUAA UAUAACUAU | 2292 |
| 1576941 | 1576952 | UUACACAUCCUC UACUCUUUUAA | 1981 | 2244 | 2266 | 1576946 | AAAAGAGUAGA GGAUGUGUAA | 2293 |
| 1576940 | 1576953 | UAAUAAUAGUUA UAUUAGUAACA | 1982 | 2224 | 2246 | 1576948 | UUACUAAUAUAA CUAUUAUUA | 2294 |
| 1576956 | 1576966 | AUCUCUAGUAUC UCUCAUGGGUU | 1983 | 2384 | 2406 | 1576961 | CCCAUGAGAGAU ACUAGAGAU | 2295 |
| 1576957 | 1576967 | UAGUAUCUCUCA UGGGUUCAGAA | 1984 | 2379 | 2401 | 1576960 | CUGAACCCAUGA GAGAUACUA | 2296 |
| 1576959 | 1576970 | UCUCCUUCACUA UUGAGUUAGCA | 1985 | 2344 | 2366 | 1576964 | CUAACUCAAUAG UGAAGGAGA | 2297 |
| 1576955 | 1576968 | CCAAACACUUUC CACUCCCCAUC | 1986 | 2404 | 2426 | 1576963 | UGGGGAGUGGA AAGUGUUUGG | 2298 |
| 1576958 | 1576971 | GUUCAGAAAAUU UAAUAGUGUCU | 1987 | 2364 | 2386 | 1576965 | ACACUAUUAAAU UUUCUGAAC | 2299 |
| 1576954 | 1576969 | GCAACACUUGUG UAAGAAACCAA | 1988 | 2324 | 2346 | 1576962 | GGUUUCUUACAC AAGUGUUGC | 2300 |
| 1576974 | 1576985 | UUGUUUUUAGGA AUUUCCAGCUU | 1989 | 2484 | 2506 | 1576979 | GCUGGAAAUUCC UAAAAACAA | 2301 |
| 1576976 | 1576988 | CUUGUAGAUGAG GCGUCACUUAA | 1990 | 2464 | 2486 | 1576984 | AAGUGACGCCUC AUCUACAAG | 2302 |
| 1576977 | 1576989 | UAAGAAAUCUCU GCCCUUCUGUU | 1991 | 2444 | 2466 | 1576982 | CAGAAGGGCAGA GAUUUCUUA | 2303 |
| 1576975 | 1576983 | UUUAGGAAUUUC CAGCUUGUAGA | 1992 | 2479 | 2501 | 1576978 | UACAAGCUGGAA AUUCCUAAA | 2304 |
| 1576972 | 1576986 | GUUCUUCAGAUA UCCCUGAACCA | 1993 | 2424 | 2446 | 1576981 | GUUCAGGGAUAU CUGAAGAAC | 2305 |
| 1576973 | 1576987 | GUUGUUUAUAAG CUUUCUACUUG | 1994 | 2504 | 2526 | 1576980 | AGUAGAAAGCUU AUAAACAAC | 2306 |
| 1576993 | 1577004 | GAAUAUGACUAA UCAGUUCAAAU | 1995 | 2604 | 2626 | 1576996 | UUGAACUGAUUA GUCAUAUUC | 2307 |
| 1576995 | 1577006 | GACUAGGGAUAC UUUCUGUAUUG | 1996 | 2564 | 2586 | 1577000 | AUACAGAAAGUA UCCCUAGUC | 2308 |
| 1576992 | 1577002 | ACAGUGUAAUCA AAGGAAUAUGA | 1997 | 2619 | 2641 | 1576998 | AUAUUCCUUUGA UUACACUGU | 2309 |
| 1576994 | 1577007 | UUGGUAAUUUAC UAAAACCAGUG | 1998 | 2544 | 2566 | 1577001 | CUGGUUUUAGUA AAUUACCAA | 2310 |

TABLE 62-continued

RNAi compounds targeting human PLN SEQ ID NO: 1

| Compound Number | Antisense ID | Antisense Sequence (5' to 3') | SEQ ID NO. | SEQ ID NO: 1 Antisense Start Site | SEQ ID NO: 1 Antisense Stop Site | Sense ID | Sense Sequence (5' to 3') | SEQ ID NO. |
|---|---|---|---|---|---|---|---|---|
| 1576990 | 1577005 | GUGAGGUGAGUG UAUCACCUGUU | 1999 | 2524 | 2546 | 1576999 | CAGGUGAUACAC UCACCUCAC | 2311 |
| 1576991 | 1577003 | AAUUUUCCACUU GUUUUUAAGAC | 2000 | 2584 | 2606 | 1576997 | CUUAAAAACAAG UGGAAAAUU | 2312 |
| 1577013 | 1577024 | UUUACUGAGAAA AAUAUUGUAAC | 2001 | 2644 | 2666 | 1577018 | UACAAUAUUUUU CUCAGUAAA | 2313 |
| 1577008 | 1577022 | AACAAACAGUGU AAUCAAAGGAA | 2002 | 2624 | 2646 | 1577016 | CCUUUGAUUACA CUGUUUGUU | 2314 |
| 1577011 | 1577021 | UCUAUCAAAGAA UGAAGAACAAA | 2003 | 2684 | 2706 | 1577014 | UGUUCUUCAUUC UUUGAUAGA | 2315 |
| 1577010 | 1577020 | AAUAAGAUUUUA AUUUCUAUCAA | 2004 | 2699 | 2721 | 1577015 | GAUAGAAAUUA AAAUCUUAUU | 2316 |
| 1577012 | 1577025 | AAAAAAAUUAGU UAUUUCUGUUU | 2005 | 2664 | 2686 | 1577019 | ACAGAAAUAACU AAUUUUUUU | 2317 |
| 1577009 | 1577023 | CACAGAAUAAGA UUUUAAUUUCU | 2006 | 2704 | 2726 | 1577017 | AAAUUAAAAUCU UAUUCUGUG | 2318 |
| 1577028 | 1577041 | UUAUUUAAAGAG UUUAUUCUACU | 2007 | 2759 | 2781 | 1577038 | UAGAAUAAACUC UUUAAAUAA | 2319 |
| 1577026 | 1577037 | UUAUAGUAUUCU GUAAUCCUCAC | 2008 | 2724 | 2746 | 1577032 | GAGGAUUACAGA AUACUAUAA | 2320 |
| 1577030 | 1577043 | UUGUUUUCUUAU AUCUUAUUCUU | 2009 | 2804 | 2826 | 1577039 | GAAUAAGAUAU AAGAAAACAA | 2321 |
| 1577027 | 1577035 | AAUAAUUAUUUA AAGAGUUUAUU | 2010 | 2764 | 2786 | 1577033 | UAAACUCUUUAA AUAAUUAUU | 2322 |
| 1577031 | 1577042 | AUUCUACUUUAU AAUUUGAGUUA | 2011 | 2744 | 2766 | 1577036 | ACUCAAAUUAUA AAGUAGAAU | 2323 |
| 1577029 | 1577040 | CUUUACACUUUA UGAUGAAGAAU | 2012 | 2784 | 2806 | 1577034 | UCUUCAUCAUAA AGUGUAAAG | 2324 |
| 1577045 | 1577058 | GCAUUUUAAAAU UGUUUUUAGUG | 2013 | 2904 | 2926 | 1577052 | CUAAAAACAAUU UUAAAAUGC | 2325 |
| 1577049 | 1577060 | AGAACUUAUUCU AUAGUAGAACA | 2014 | 2864 | 2886 | 1577054 | UUCUACUAUAGA AUAAGUUCU | 2326 |
| 1577046 | 1577057 | CUGUAAAUUAAG AUAAGAACUUA | 2015 | 2879 | 2901 | 1577050 | AGUUCUUAUCUU AAUUUACAG | 2327 |
| 1577047 | 1577056 | GUGCCCUGUAAA UUAAGAUAAGA | 2016 | 2884 | 2906 | 1577051 | UUAUCUUAAUUU ACAGGGCAC | 2328 |
| 1577048 | 1577061 | ACAUAUUUGAGC AUUUAGUAUAU | 2017 | 2844 | 2866 | 1577055 | AUACUAAAUGCU CAAAUAUGU | 2329 |
| 1577044 | 1577059 | UAUUAAAUUUUA AAAAUAAAUUG | 2018 | 2824 | 2846 | 1577053 | AUUUAUUUUUA AAAUUUAAUA | 2330 |
| 1577066 | 1577075 | AAUAUAAAAGGC AACAUUAAGCA | 2019 | 2924 | 2946 | 1577071 | CUUAAUGUUGCC UUUUAUAUU | 2331 |
| 1577067 | 1577079 | UUCAAGAACAUU CAUUUUAAUAU | 2020 | 2994 | 3016 | 1577073 | AUUAAAAUGAA UGUUCUUGAA | 2332 |
| 1577065 | 1577078 | AUAUAUUCUUAA CCAAUUAAAAU | 2021 | 2944 | 2966 | 1577072 | UUUAAUUGGUU AAGAAUAUAU | 2333 |
| 1577064 | 1577077 | CUGAUUUGCAUU AAACAAAUAUA | 2022 | 2964 | 2986 | 1577069 | UAUUUGUUUAA UGCAAAUCAG | 2334 |

TABLE 62-continued

| RNAi compounds targeting human PLN SEQ ID NO: 1 | | | | | | | | | |
|---|---|---|---|---|---|---|---|---|---|
| Compound Number | Antisense ID | Antisense Sequence (5' to 3') | SEQ ID NO. | SEQ ID NO: 1 Antisense Start Site | SEQ ID NO: 1 Antisense Stop Site | Sense ID | Sense Sequence (5' to 3') | SEQ ID NO. |
| 1577063 | 1577076 | AUUUUAAUAUAG UGAUUCUGAUU | 2023 | 2981 | 3003 | 1577068 | UCAGAAUCACUA UAUUAAAAU | 2335 |
| 1577062 | 1577074 | AAAAGGCAACAU UAAGCAUUUUA | 2024 | 2919 | 2941 | 1577070 | AAAUGCUUAAUG UUGCCUUUU | 2336 |

Example 13: Effect of RNAi Compounds on Human PLN RNA In Vitro, Single Dose

Double-stranded RNAi compounds described above are tested in a series of experiments under the same culture conditions.

Cultured iCell® cardiomyocytes[2] (FujiFilm Cellular Dynamics, Inc.; Catalog No: R1017) at a density of 20,000 cells per well are transfected using Lipofectamine 2000 with 20 nM of double-stranded RNAi. After a treatment period of approximately 24 hours, RNA is isolated from the cells and PLN RNA levels are measured by quantitative real-time RTPCR. Human primer-probe set RTS40402 (described herein above) may be used to measure RNA levels. PLN RNA levels are normalized to total RNA content, as measured by RIBOGREEN®.

Example 14: Effect of RNAi Compounds on Human PLN RNA in iPSC-Derived Cardiomyocytes Double-stranded RNAi compounds described above are tested in a series of experiments under the same culture conditions.

Cultured iCell® cardiomyocytes[2] (FujiFilm Cellular Dynamics, Inc.; Catalog No: R1017) were treated with modified oligonucleotide at a concentration of 125 nM using Lipofectin at a density of 8,000 cells per well. After a treatment period of approximately 24 hours, total RNA was isolated from the cells and PLN RNA levels were measured by quantitative real-time RTPCR. PLN RNA levels were measured by human primer-probe set RTS40406 (described herein above) and human primer-probe set ABI53044 (forward sequence CACCCGTAAGACTTCATACAACACA, designated herein as SEQ ID NO: 12; reverse sequence TGGCAGCCAAATATGAGATAACTGT, designated herein as SEQ ID NO: 13; probe sequence TGCCAAGGCTACCTAA, designated herein as SEQ ID NO: 14). PLN RNA levels were normalized to total RNA content, as measured by RIBOGREEN®. Reduction of PLN RNA is presented in the table below as percent PLN RNA relative to the amount of PLN RNA in untreated control cells (% UTC). The values marked with a "†" indicate that the modified oligonucleotide is complementary to the amplicon region of the primer probe set. Additional assays may be used to measure the potency and efficacy of the modified oligonucleotides complementary to the amplicon region. Each table represents a separate experiment.

TABLE 62

Reduction of PLN RNA by double-stranded RNAi compounds at a concentration of 125 nM in iCell ® cardiomyocytes[2]

| Compound Number | PLN (% UTC) RTS40406 | PLN (% UTC) ABI53044 |
|---|---|---|
| 1564108 | 112 | 99 |
| 1564109 | 99 | 78 |
| 1564110 | 124 | 119 |
| 1564111 | 89 | 72 |
| 1564112 | 87 | 73 |
| 1564113 | 145 | 113 |
| 1564126 | 72 | 62 |
| 1564127 | 83 | 74 |
| 1564128 | 100 | 79 |
| 1564129 | 83 | 79 |
| 1564130 | 80 | 73 |
| 1564131 | 96 | 76 |
| 1564144 | 87 | 97 |
| 1564145 | 108 | 105 |
| 1564146 | 92 | 102 |
| 1564147 | 116 | 104 |
| 1564148 | 112 | 98 |
| 1564149 | 102 | 90 |
| 1564162 | 111 | 99 |
| 1564163 | 95 | 86 |
| 1564164 | 96 | 112 |
| 1564165 | 104 | 91 |
| 1564166 | 95 | 84 |
| 1564167 | 109 | 93 |
| 1564180 | 86 | 84 |
| 1564181 | 104 | 100 |
| 1564182 | 100 | 103 |
| 1564183 | 90 | 84 |
| 1564184 | 89 | 79 |
| 1564185 | 92 | 77 |
| 1564198 | 91 | 91 |
| 1564199 | 106 | 113 |
| 1564200 | 86 | 86 |
| 1564201 | 107 | 76 |
| 1564202 | 97 | 94 |
| 1564203 | 93 | 97 |
| 1564216 | 78 | 87 |
| 1564217 | 86 | 87 |
| 1564218 | 107 | 93 |
| 1564219 | 54 | 38 |
| 1564220 | 88 | 87 |
| 1564221 | 84 | 75 |
| 1564234 | 83 | 96 |
| 1564235 | 91 | 100 |
| 1564236 | 99 | 89 |
| 1564237 | 92 | 79 |
| 1564238 | 82 | 92 |
| 1564239 | 88 | 99 |
| 1564252 | 145 | 224 |
| 1564253 | 83 | 105 |
| 1564254 | 108 | 129 |
| 1564255 | 80 | 71 |
| 1564256 | 75 | 77 |
| 1564257 | 92 | 87 |

TABLE 62-continued

Reduction of PLN RNA by double-stranded RNAi compounds at a concentration of 125 nM in iCell ® cardiomyocytes[2]

| Compound Number | PLN (% UTC) RTS40406 | PLN (% UTC) ABI53044 |
|---|---|---|
| 1564270 | 92 | 135 |
| 1564271 | 80 | 99 |
| 1564272 | 91 | 103 |
| 1564273 | 74 | 68 |
| 1564274 | 79 | 83 |
| 1564275 | 74 | 102 |
| 1564288 | 108 | 89 |
| 1564289 | 87 | 86 |
| 1564290 | 77 | 107 |
| 1564291 | 83 | 85 |
| 1564292 | 70 | 81 |
| 1564293 | 65 | 96 |
| 1564306 | 96 | 84 |
| 1564307 | 70 | 81 |
| 1564308 | 73 | 99 |
| 1564309 | 68 | 88 |
| 1564310 | 78 | 87 |
| 1564311 | 73 | 75 |
| 1564324 | 77 | 83 |
| 1564325 | 71 | 89 |
| 1564326 | 83 | 103 |
| 1564327 | 81 | 85 |
| 1564328 | 68 | 101 |
| 1564329 | 82 | 81 |

TABLE 63

Reduction of PLN RNA by double-stranded RNAi compounds at a concentration of 125 nM in iCell ® cardiomyocytes[2]

| Compound Number | PLN (% UTC) RTS40406 | PLN (% UTC) ABI53044 |
|---|---|---|
| 1563874 | 155 | 138 |
| 1563875 | 7† | 3† |
| 1563876 | 14† | 14† |
| 1563877 | 10† | 7† |
| 1563878 | 122† | 123† |
| 1563879 | 3† | 2† |
| 1563892 | 121 | 124 |
| 1563893 | 77 | 64 |
| 1563894 | 94 | 80 |
| 1563895 | 109 | 102 |
| 1563896 | 104 | 89 |
| 1563897 | 22† | 22† |
| 1563910 | 48 | 47 |
| 1563911 | 84 | 93 |
| 1563912 | 50 | 57 |
| 1563913 | 83 | 85 |
| 1563914 | 70 | 67 |
| 1563915 | 67 | 66 |
| 1563928 | 99 | 102 |
| 1563929 | 61 | 63 |
| 1563930 | 96 | 96 |
| 1563931 | 56 | 55 |
| 1563932 | 81 | 99 |
| 1563933 | 55 | 50 |
| 1563946 | 61 | 69 |
| 1563947 | 57 | 68 |
| 1563948 | 55 | 54 |
| 1563949 | 46 | 44 |
| 1563950 | 45 | 46 |
| 1563951 | 35 | 29 |
| 1563964 | 56 | 72 |
| 1563965 | 67 | 79 |
| 1563966 | 86 | 89 |
| 1563967 | 116 | 134 |
| 1563968 | 59 | 58 |
| 1563969 | 80 | 89 |

TABLE 63-continued

Reduction of PLN RNA by double-stranded RNAi compounds at a concentration of 125 nM in iCell ® cardiomyocytes[2]

| Compound Number | PLN (% UTC) RTS40406 | PLN (% UTC) ABI53044 |
|---|---|---|
| 1563982 | 14 | 11 |
| 1563983 | 76 | 86 |
| 1563984 | 74 | 78 |
| 1563985 | 52 | 36 |
| 1563986 | 60 | 66 |
| 1563987 | 76 | 71 |
| 1564000 | 82 | 95 |
| 1564001 | 103 | 109 |
| 1564002 | 53 | 74 |
| 1564003 | 78 | 87 |
| 1564004 | 72 | 78 |
| 1564005 | 75 | 80 |
| 1564018 | 58 | 60 |
| 1564019 | 86 | 85 |
| 1564020 | 79 | 73 |
| 1564021 | 62 | 60 |
| 1564022 | 79 | 80 |
| 1564023 | 71 | 85 |
| 1564036 | 56 | 66 |
| 1564037 | 75 | 87 |
| 1564038 | 68 | 82 |
| 1564039 | 79 | 92 |
| 1564040 | 76 | 81 |
| 1564041 | 67 | 82 |
| 1564054 | 62 | 68 |
| 1564055 | 73 | 86 |
| 1564056 | 89 | 91 |
| 1564057 | 70 | 75 |
| 1564058 | 62 | 78 |
| 1564059 | 93 | 106 |
| 1564072 | 68 | 84 |
| 1564073 | 67 | 81 |
| 1564074 | 83 | 89 |
| 1564075 | 60 | 55 |
| 1564084 | 68 | 70 |
| 1564085 | 78 | 78 |
| 1564090 | 63 | 68 |
| 1564091 | 104 | 138 |
| 1564092 | 99 | 114 |
| 1564093 | 69 | 77 |
| 1564094 | 69 | 65 |
| 1564095 | 56 | 65 |

TABLE 64

Reduction of PLN RNA by double-stranded RNAi compounds at a concentration of 125 nM in iCell ® cardiomyocytes[2]

| Compound Number | PLN (% UTC) RTS40406 | PLN (% UTC) ABI53044 |
|---|---|---|
| 1576846 | 78 | 61 |
| 1576847 | 107 | 76 |
| 1576848 | 78 | 73 |
| 1576849 | 101 | 86 |
| 1576850 | 70 | 63 |
| 1576851 | 80 | 59 |
| 1576864 | 120 | 106 |
| 1576865 | 149 | 126 |
| 1576866 | 109 | 93 |
| 1576867 | 91 | 75 |
| 1576868 | 123 | 112 |
| 1576869 | 107 | 84 |
| 1576882 | 84 | 78 |
| 1576883 | 104 | 69 |
| 1576884 | 106 | 86 |
| 1576885 | 97 | 81 |
| 1576886 | 112 | 81 |
| 1576887 | 93 | 68 |

TABLE 64-continued

Reduction of PLN RNA by double-stranded RNAi compounds at a concentration of 125 nM in iCell ® cardiomyocytes[2]

| Compound Number | PLN (% UTC) RTS40406 | PLN (% UTC) ABI53044 |
|---|---|---|
| 1576900 | 94 | 72 |
| 1576901 | 90 | 84 |
| 1576902 | 97 | 91 |
| 1576903 | 130 | 98 |
| 1576904 | 107 | 74 |
| 1576905 | 89 | 78 |
| 1576918 | 103 | 77 |
| 1576919 | 97 | 84 |
| 1576920 | 116 | 79 |
| 1576921 | 88 | 79 |
| 1576922 | 75 | 76 |
| 1576923 | 109 | 85 |
| 1576936 | 102 | 69 |
| 1576937 | 105 | 83 |
| 1576938 | 93 | 72 |
| 1576939 | 134 | 108 |
| 1576940 | 86 | 66 |
| 1576941 | 103 | 84 |
| 1576954 | 84 | 79 |
| 1576955 | 21 | 14 |
| 1576956 | 102 | 71 |
| 1576957 | 106 | 80 |
| 1576958 | 97 | 76 |
| 1576959 | 105 | 85 |
| 1576972 | 129 | 89 |
| 1576973 | 92 | 74 |
| 1576974 | 78 | 76 |
| 1576975 | 108 | 71 |
| 1576976 | 99 | 72 |
| 1576977 | 117 | 95 |
| 1576990 | 121 | 93 |
| 1576991 | 109 | 89 |
| 1576992 | 58 | 39 |
| 1576993 | 106 | 104 |
| 1576994 | 101 | 72 |
| 1576995 | 108 | 84 |
| 1577008 | 93 | 69 |
| 1577009 | 102 | 77 |
| 1577010 | 113 | 77 |
| 1577011 | 95 | 87 |
| 1577012 | 97 | 91 |
| 1577013 | 78 | 73 |
| 1577026 | 112 | 86 |
| 1577027 | 99 | 66 |
| 1577028 | 90 | 83 |
| 1577029 | 104 | 71 |
| 1577030 | 88 | 90 |
| 1577031 | 97 | 79 |
| 1577044 | 101 | 102 |
| 1577045 | 91 | 85 |
| 1577046 | 90 | 84 |
| 1577047 | 88 | 76 |
| 1577048 | 96 | 86 |
| 1577049 | 85 | 75 |
| 1577062 | 75 | 79 |
| 1577063 | 90 | 85 |
| 1577064 | 77 | 85 |
| 1577065 | 77 | 86 |
| 1577066 | 86 | 83 |
| 1577067 | 80 | 77 |

TABLE 65

Reduction of PLN RNA by double-stranded RNAi compounds at a concentration of 125 nM in iCell ® cardiomyocytes[2]

| Compound Number | PLN (% UTC) RTS40406 | PLN (% UTC) ABI53044 |
|---|---|---|
| 1576612 | 83† | 69 |
| 1576613 | 35† | 27† |
| 1576614 | 4† | 2† |
| 1576615 | 3† | 1† |
| 1576616 | 5† | 18† |
| 1576617 | 9† | 10† |
| 1576630 | 29† | 50† |
| 1576631 | 33 | 35 |
| 1576632 | 96 | 75 |
| 1576633 | 74 | 66 |
| 1576634 | 84 | 56 |
| 1576635 | 77 | 48 |
| 1576648 | 72 | 61 |
| 1576649 | 89 | 75 |
| 1576650 | 21 | 15 |
| 1576651 | 34 | 27 |
| 1576652 | 3 | 3 |
| 1576653 | 20 | 25 |
| 1576666 | 37 | 36 |
| 1576667 | 47 | 42 |
| 1576668 | 73 | 69 |
| 1576669 | 69 | 60 |
| 1576670 | 72 | 49 |
| 1576671 | 50 | 33 |
| 1576684 | 47 | 58 |
| 1576685 | 73 | 45 |
| 1576686 | 63 | 39 |
| 1576687 | 47 | 45 |
| 1576688 | 65 | 49 |
| 1576689 | 25 | 24 |
| 1576702 | 92 | 37 |
| 1576703 | 73 | 52 |
| 1576704 | 70 | 54 |
| 1576705 | 85 | 75 |
| 1576706 | 57 | 46 |
| 1576707 | 86 | 59 |
| 1576720 | 81 | 59 |
| 1576721 | 76 | 49 |
| 1576722 | 111 | 81 |
| 1576723 | 27 | 14 |
| 1576724 | 77 | 56 |
| 1576725 | 72 | 48 |
| 1576738 | 63 | 49 |
| 1576739 | 71 | 52 |
| 1576740 | 83 | 58 |
| 1576741 | 120 | 88 |
| 1576742 | 71 | 58 |
| 1576743 | 86 | 74 |
| 1576756 | 64 | 55 |
| 1576757 | 80 | 54 |
| 1576758 | 79 | 62 |
| 1576759 | 116 | 78 |
| 1576760 | 74 | 53 |
| 1576761 | 21 | 14 |
| 1576774 | 80 | 61 |
| 1576775 | 76 | 63 |
| 1576776 | 103 | 75 |
| 1576777 | 76 | 51 |
| 1576778 | 76 | 70 |
| 1576779 | 66 | 50 |
| 1576792 | 82 | 60 |
| 1576793 | 76 | 61 |
| 1576794 | 59 | 50 |
| 1576795 | 80 | 65 |
| 1576796 | 102 | 82 |
| 1576797 | 105 | 96 |
| 1576810 | 86 | 72 |
| 1576811 | 112 | 80 |
| 1576812 | 94 | 106 |
| 1576813 | 92 | 81 |
| 1576814 | 67 | 63 |
| 1576815 | 106 | 91 |
| 1576828 | 64 | 55 |

TABLE 65-continued

Reduction of PLN RNA by double-stranded RNAi compounds at a concentration of 125 nM in iCell ® cardiomyocytes[2]

| Compound Number | PLN (% UTC) RTS40406 | PLN (% UTC) ABI53044 |
|---|---|---|
| 1576829 | 44 | 43 |
| 1576830 | 72 | 61 |
| 1576831 | 62 | 59 |
| 1576832 | 79 | 81 |
| 1576833 | 98 | 95 |

Example 15: Dose-Dependent Inhibition of Human PLN in iCell® Cardiomyocytes[2] by RNAi Compounds Double-stranded RNAi compounds selected from the examples above were tested at various doses in iCell® cardiomyocytes[2] (FujiFilm Cellular Dynamics, Inc.; Catalog No: R1017). Cultured iCell® cardiomyocytes[2] at a density of 8,000 cells per well were treated by electroporation with various concentrations of modified oligonucleotide as specified in the tables below. After a treatment period of approximately 24 hours, total RNA was isolated from the cells, and PLN RNA levels were measured by quantitative real-time RTPCR. Human PLN primer-probe set RTS40406 (described herein above) and human primer-probe set ABI53044 (described herein above) were used to measure RNA levels as described above. PLN RNA levels were normalized to total RNA content, as measured by RIBOGREEN®. Reduction of PLN RNA is presented in the tables below as percent PLN RNA, relative to PLN RNA in untreated control cells (% UTC).

The half maximal inhibitory concentration ($IC_{50}$) of each modified oligonucleotide was calculated with GraphPad Prism software (v8.2.0, San Diego, CA) using the log (inhibitor) vs. normalized response—Variable slope function: Y=100/(1+10^((Log IC50−X)*HillSlope)). Each table represents a separate experiment.

TABLE 66

Dose-dependent reduction of human PLN RNA in iCell ® cardiomyocytes2 by RNAi compounds, primer-probe set ABI53044

| Compound | PLN RNA (% UTC), ABI53044 | | | | $IC_{50}$ |
|---|---|---|---|---|---|
| No. | 3 nM | 21 nM | 125 nM | 750 nM | (nM) |
| 1564127 | 62 | 59 | 53 | 47 | 328 |
| 1564128 | 81 | 64 | 48 | 47 | 219 |
| 1564130 | 74 | 59 | 49 | 51 | 338 |
| 1564163 | 88 | 84 | 88 | 70 | >750 |
| 1564201 | 98 | 87 | 83 | 81 | >750 |
| 1564216 | 110 | 96 | 99 | 95 | >750 |
| 1564219 | 109 | 86 | 76 | 82 | >750 |
| 1564221 | 95 | 83 | 80 | 73 | >750 |
| 1576631 | 82 | 63 | 48 | 28 | 89 |
| 1576650 | 92 | 56 | 29 | 6 | 34 |
| 1576651 | 96 | 75 | 57 | 20 | 139 |
| 1576652 | 50 | 33 | 7 | 3 | 4 |
| 1576653 | 46 | 30 | 15 | 10 | <3 |
| 1576686 | 59 | 38 | 25 | 29 | 6 |
| 1576689 | 62 | 42 | 18 | 8 | 9 |
| 1576706 | 67 | 48 | 36 | 34 | 26 |
| 1576723 | 82 | 68 | 56 | 134 | >750 |
| 1576761 | 62 | 54 | 28 | 3 | 15 |
| 1576828 | 77 | 56 | 53 | 59 | >750 |

TABLE 67

Dose-dependent reduction of human PLN RNA in iCell ® cardiomyocytes[2] by RNAi compounds, primer-probe set ABI53044

| Compound | PLN RNA (% UTC), ABI53044 | | | | $IC_{50}$ |
|---|---|---|---|---|---|
| No. | 3 nM | 21 nM | 125 nM | 750 nM | (nM) |
| 1563950 | 53 | 32 | 23 | 20 | 3 |
| 1563951 | 41 | 36 | 22 | 21 | <3 |
| 1563964 | 65 | 52 | 42 | 35 | 34 |
| 1563965 | 80 | 57 | 42 | 44 | 114 |
| 1563982 | 53 | 40 | 17 | 8 | 5 |
| 1563985 | 88 | 80 | 65 | 80 | >750 |
| 1576723 | 76 | 67 | 59 | 66 | >750 |
| 1576850 | 60 | 55 | 44 | 42 | 54 |
| 1576900 | 87 | 81 | 88 | 73 | >750 |
| 1576905 | 81 | 82 | 68 | 70 | >750 |
| 1576936 | 102 | 99 | 79 | 74 | >750 |
| 1576939 | 105 | 92 | 77 | 93 | >750 |
| 1576955 | 103 | 93 | 84 | 102 | >750 |
| 1576992 | 91 | 81 | 88 | 77 | >750 |
| 1576995 | 111 | 106 | 96 | 95 | >750 |
| 1577009 | 103 | 103 | 88 | 87 | >750 |
| 1577010 | 94 | 93 | 85 | 90 | >750 |
| 1577012 | 99 | 94 | 86 | 90 | >750 |
| 1577044 | 116 | 109 | 100 | 95 | >750 |
| 1577048 | 96 | 90 | 87 | 86 | >750 |

TABLE 68

Dose-dependent reduction of human PLN RNA in iCell ® cardiomyocytes[2] by RNAi compounds, primer-probe set RTS40406

| Compound | PLN RNA (% UTC), RTS40406 | | | | $IC_{50}$ |
|---|---|---|---|---|---|
| No. | 3 nM | 21 nM | 125 nM | 750 nM | (nM) |
| 1564127 | 64 | 57 | 53 | 49 | 418 |
| 1564128 | 87 | 68 | 51 | 46 | 260 |
| 1564130 | 75 | 62 | 51 | 53 | ND |
| 1564163 | 93 | 89 | 95 | 72 | >750 |
| 1564201 | 97 | 87 | 85 | 81 | >750 |
| 1564216 | 105 | 94 | 99 | 96 | >750 |
| 1564219 | 111 | 89 | 80 | 83 | >750 |
| 1564221 | 95 | 85 | 83 | 75 | >750 |
| 1576631 | 86 | 63 | 40 | 15 | 55 |
| 1576650 | 92 | 56 | 30 | 6 | 35 |
| 1576651 | 99 | 72 | 52 | 19 | 118 |
| 1576652 | 52 | 32 | 6 | 3 | 4 |
| 1576653 | 46 | 29 | 12 | 5 | <3 |
| 1576686 | 58 | 37 | 26 | 28 | 5 |
| 1576689 | 67 | 43 | 17 | 7 | 11 |
| 1576706 | 68 | 50 | 37 | 36 | 32 |
| 1576723 | 87 | 68 | 55 | 109 | >750 |
| 1576761 | 63 | 55 | 29 | 3 | 16 |
| 1576828 | 78 | 57 | 54 | 55 | >750 |

TABLE 69

Dose-dependent reduction of human PLN RNA in iCell ® cardiomyocytes[2] by RNAi compounds, primer-probe set RTS40406

| Compound | PLN RNA (% UTC), RTS40406 | | | | $IC_{50}$ |
|---|---|---|---|---|---|
| No. | 3 nM | 21 nM | 125 nM | 750 nM | (nM) |
| 1563950 | 54 | 34 | 24 | 19 | 4 |
| 1563951 | 40 | 36 | 21 | 19 | <3 |
| 1563964 | 66 | 49 | 41 | 37 | 33 |
| 1563965 | 78 | 58 | 44 | 42 | 117 |
| 1563982 | 54 | 39 | 16 | 7 | 5 |
| 1563985 | 86 | 84 | 65 | 76 | >750 |
| 1576723 | 77 | 70 | 60 | 68 | >750 |

TABLE 69-continued

| Dose-dependent reduction of human PLN RNA in iCell ® cardiomyocytes[2] by RNAi compounds, primer-probe set RTS40406 | | | | | |
|---|---|---|---|---|---|
| Compound | PLN RNA (% UTC), RTS40406 | | | | $IC_{50}$ |
| No. | 3 nM | 21 nM | 125 nM | 750 nM | (nM) |
| 1576850 | 61 | 55 | 46 | 43 | 69 |
| 1576900 | 85 | 84 | 91 | 76 | >750 |
| 1576905 | 79 | 84 | 70 | 75 | >750 |
| 1576936 | 106 | 107 | 80 | 78 | >750 |
| 1576939 | 106 | 90 | 76 | 94 | >750 |
| 1576955 | 106 | 95 | 85 | 105 | >750 |
| 1576992 | 89 | 81 | 91 | 76 | >750 |
| 1576995 | 119 | 107 | 96 | 98 | >750 |
| 1577009 | 109 | 105 | 86 | 84 | >750 |
| 1577010 | 99 | 101 | 93 | 97 | >750 |
| 1577012 | 104 | 100 | 91 | 98 | >750 |
| 1577044 | 113 | 105 | 99 | 94 | >750 |
| 1577048 | 100 | 95 | 88 | 86 | >750 |

Example 16: Design of Modified Oligonucleotides Complementary to Human PLN Nucleic Acid Modified oligonucleotides complementary to a human PLN nucleic acid were designed, as described in the table below. "Start site" indicates the 5'-most nucleoside to which the modified oligonucleotide is complementary in the target nucleic acid sequence. "Stop site" indicates the 3'-most nucleoside to which the modified oligonucleotide is complementary in the target nucleic acid sequence. Each modified oligonucleotide listed in the tables below is 100% complementary to SEQ ID NO: 1 (described herein above), to SEQ ID NO: 2 (described herein above), or to both. 'N/A' indicates that the modified oligonucleotide is not 100% complementary to that particular target nucleic acid sequence.

Each modified oligonucleotide in the table below is conjugated to a 6-palmitamidohexyl phosphate conjugate group attached to the 5'-OH of the oligonucleotide. The structure for the conjugate group is:

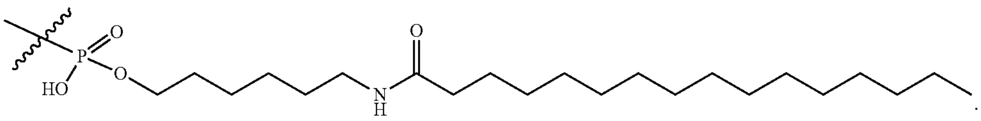

The modified oligonucleotides in the table below are 3-10-3 cEt modified oligonucleotides with mixed internucleoside linkages. The modified oligonucleotides are 16 nucleosides in length. The sugar motif for the modified oligonucleotides is (from 5' to 3'): kkkddddddddddkkk; wherein each "d" represents a 2'-β-D-deoxyribosyl sugar moiety, and each "k" represents a cEt modified sugar moiety. The internucleoside linkage motifs for the modified oligonucleotides are described in the column labeled "Internucleoside Linkage Motif (5' to 3')" in the table below, wherein each "s" represents a phosphorothioate internucleoside linkage and each "o" represents a phosphodiester internucleoside linkage. All cytosine nucleobases are 5-methylcytosines.

TABLE 70

| 6-palmitamidohexyl phosphate conjugated 3-10-3 cEt modified oligonucleotides with mixed internucleoside linkages complementary to human PLN | | | | | | | |
|---|---|---|---|---|---|---|---|
| Compound No. | Sequence (5' to 3') | SEQ ID NO: 1 Start Site | SEQ ID NO: 1 Stop Site | SEQ ID NO: 2 Start Site | SEQ ID NO: 2 Stop Site | Internucleoside Linkage Motif (5' to 3') | SEQ ID NO |
| 1558166 | ACACGAGTATATTAGG | N/A | N/A | 5501 | 5516 | soosssssssssos | 609 |
| 1558167 | GTAGTTAAGATTTTGC | 1530 | 1545 | 15224 | 15239 | soosssssssssos | 752 |

SEQUENCE LISTING (2336 sequences)

SEQ ID NO: 1 - DNA, 3021 bp, Homo sapiens
actttttctcctccacctactgcaactgttcccataaactgggtgacagagtcagaaaactccccagctaaacacccgtaagacttcatacaacacaatactctatactgtgatgatcacagctgccaaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgcagtccactctactgagctaaattatagatccagctatgctatttataattattttcttgatgaataaattttcaatttctcctctgaccatttcagaacatcttccaataactcataaaacaactgaagtaaaattgagtgctggaaaatatattcaccaaactttggtaatttaagttgactaaagtttaaaattaagtctaaaatagtttacacctatactgcataatccaacaattttaatttcagttgaagacatgttactaatataactattattaaaagagtagaggatgtgtaattaaccatatcttctaaaacatggttactaaaagaatatgtaacatcaatattgaccttggtttcttacacaagtgttgctaactcaatagtgaaggagacactattaaattttctgaacccatgagagatactagagatggggagtggaaagtgtttggttcagggatatctgaagaacagaagggcagagatttcttaagtgacgcctcatctacaagctggaaattcctaaaaacaagtagaaagcttataaacaacaggtgatacactcacctcactggttttagtaaattaccaatacagaaagtatccctagtcttaaaaacaagtggaaaatttgaactgattagtcatattcctttgattacactgtttgttacaatatttttctcagtaaacagaaataactaatttttttgttcttcattctttgatagaaattaaaatcttattctgtgaggattacagaatactataactcaaattataaagtagaataaactctttaaataattattcttcatcataaagtgtaaagaataagatataagaaaacaatttatttttaaaatttaatatactaaatgctcaaatatgttctactatagaataagttcttatcttaatttacagggcactaaaaacaattttaaaatgcttaatgttgccttttatattttaattggttaagaatatatatttgtttaatgcaaatcagaatcactatattaaaatgaatgttcttgaaaactc

SEQ ID NO: 2 - DNA, 20000 bp, Homo sapiens
gataggtaaaatcttcttcctgggtgtctaggagatctaatctaaaaaaagctccttatctttgatgtattgtgaacattacaaaaattgattcaaagcttgcattttactgtatctctgtctaaatattaaaatgctttaatttagtcatcacttatattaacttctggtcaaaaatttccaaaaaccgattctattttgaagcttcttcgccctccggatacaccactacagactggagtttaaatgctcaatgtaaaagattactacatacatcacagtgcccttcacaaaacgttagtaatatagctgggcgcggtggctcacgcctgtaatcccagcactttgggaggccgaggtgggcagatcacgaggtcaggagtttgagaccagcctgggcaatatggtgaaaccccatctctactaaaaatacaaaagttagctgggcgtggtggcacacgcctgtagtctcagctacttgggaggctgaggcaggagaatcgcttgaacccgagagggagaggttgcagtgagctgagatcgcaccattcactcggggctgagtaacagagtgagactccgcacccccttccaaaaaaaattagtaatacttttgaggaacacatttaaaatgctacaaaactatataaaaacaaaagtaaagacatgaactcatgattcagttgaaactgaatactaaatttcatttagagcttagtaaaaataaatttgtaattattttcccatccaagttcaaagacactttacccttaagaatccaccttctaaaggaaaaaagaaaataagtgctaacactaaatgaacactgttgcaggatctctgataatcactatgtacacttcatgtcattaaaccatcacaaatactattccacagattaggctgcttaggaaagttatttgtataaagccatgtgaccaaaaatacattcaaactatagtgtaactccaaatgaagactgtgacaaagcacctcaaaaaaattttctagcctctagctgaggaatcattgaggaacactctactgataacactataactcattaatactcctattaaacaactttctgtttgggcaattaaaaacaatgttcagttaaaactaaaatctaatacttcctagagttccacatgagatcatcaccatcatcgtcatcttcactagctaacccaaaggaacaaggtaaacacaaaaactccccactcttgtaccaatctaaaaagtaaatttttgaatccattttccaactgtgtcacacacagttgttagtatccttctaaggtgtgtatatgcctatgtatactttttaagtaaacttataaacatgtggtaactagggcatattttattctgtctacggcagcttcttggtttatccaactaagtattactaattctattttcttagaatgagaagttctcagaacaatgatctatcacctaaatttcaaatgaatgtgtaactggtagacaaacttaaagcagactttctaaaactattaacagtgctcaagaatgcatctatttacatcttaaaaatttctcagttactatatgctactctaatgaaagctatattcaaattataattttttcccacagcatgccaacagattaggaattataaacagacagatctggatttgaatcctgtctattctttagcagctggttatctctgacaaattactgtaaacctcgttaggcttctcggttttgtattatcaatcatcattggtaactgatagtactgagagatcctcattatgtaaggattgaaagaaaaatggttgtagcactgagaaaagtatcaaacattattctgcaatttccttaacttgggttttacttttaagttgtaaattttcccttggcaatgttcacaggatatctttgctaaaatattatttttcagttagttttaagctgactctttaaatatcaaatgatttgctctagagatggattttctttctttggaagaagccaagatcatttccatttaagggcatgtaagcagctgctgctacacattttagttacccataagaaagtgaagtgggctaagttcactctgtcataagcatttaaaaaattaaaaattacaagtacctcctctaaaattaaagaagagatttaagaattaatattttcgagtgtggtgacttaagtaaatctaacatctaagacaacaaattagataaacagagaagaggagaatgatgcccggctttacaaaaaaattatttccccagttctactgtaagataaactgttctaggaagttcaaaatatcatctcacttactagcatctcatttttatagtaattttcaggaaagcaactgctagattaaatgaggcacatcctttcaaaaacattacaaaacttaaatttcaacacatcaaacctataaagcctcattaactgagatgtaactgatttggaatctgtaattatttcttttttgccataaagttgcccttaatactgcatcagtttattaaaaatttggtaagattgtgtaataatttaatgcaattgtttttaaaaaatcttaaatacttaaagtagcatattgctattttgggggtgttgtatgtatcagtttaaatataagtattactattcacaaatatattgttaaactgctaattgaagaaaacacaaatgaattaaatacatttattagttctttaactgtaagataaaaataattttttaaaacaaaaagcaattagcctgattttctcatactccttctcccatacacacaagaacaagaacaaaataagaaaacaggtataaaattttattgtgtaaaaatatttcactttcactaaaagctaacattatgaagacacgtattaaagcaacagcagcaagaattcaatgaaagttgttttgcttatacctgtgtttatttttctcataattaaaattcctgcagtaactattttagctcttcaacatcttcaccattaatattcaattatctctaagcctgaagatgcatgaatctttaacaaaagctttccaccacctcaagtttacttatttttttcatttatctaccatatactgttttaaattaaaaacaaaagatgaagcacaaagtgttaatgacttttccatacctaaagtaagaagttctaaagtttggttgtgataagactgagactgtggctaaccaatcgaaacttcagaattcctatgtgacatcataagacctccctagaacactttttctcctccacctactgcaactgttcccataaactgggtgacagagtcagaaaactccccagctaaacacccgtaagacttcatacaacacaatactctatactgtgatgatcacagctgccaaggtaagaaacagatttcgctgactttggtaattcttactttctataattcttaattcctataatttctataatctgaacttttaaaatgagttaattttatgaatatcagttcaatcttaggcaataaaatgacatgacaaagtgcttaaatttataaatgcttatccatttagtgacaggaaaaatgagacaactttgaaatgaaaaaggtcatattcatctttgatcctggttactggtttgtcatttaaatttatctttcacttttattttgcttttcaaatgtgaatttctgccaattaaaaaatcttccaattatgttaccatatttggtagtagtggttaatttctccatgcaaaaacaatgacttaattttgttatttattgctctgctgagaaacagtgcagaactgagctatttacatctgaactaatatgaatagtcatttgactacaacatgcacattatcagcatgcctattccaatattatcataatttcatacagtgaataatgaaatggagtttcagaatatataatacaagctacttttaaagtgcccttgaggatgtttcccctctaaagtccagtcaacttttaacaaacatttctaaaaaaattccatgctattaataaattgagttactgatattaaattcaatattgtatcataaagaagtttagaaattttaaaacaatgttcacaaacacaaaaaatctgacgttagagaataatttgatactttaaaaagttattttgacacacgaatattcttaactatcttattttcacacaaatttgattaaatggatttctgcctattaatgcctatagttttgtcaagttattatcctccagtggtactccatttcctctctcggatttagaaagaaaggaaaaaataaaataaatgccaggaatggagatgccacaatcaattttatgacttctgtttgaattctaccctattctttatgttacaatcctcaatttagtaaatgaaacgtttcctcattcttagatctctgtcagggcatacagaaaattacatatattttatttattttgattttcatatttcatatatatgttaaaataaaatttatctctaaaattctcaattcctatgacaaatgttaattctattgctcactacaaataagaactttgtaactctgtaagcagctttccttaagacataaaaaaacataatttttgtctaccactgaggtatcctaattgtgtctccatatctctatactcatatttttcctttgatagtacataaaagtcattcagtgtaggtgtcttatgttatttgtgcatttttattcaaatatctatcaaattacattctcacacttcaaattgggtgttcacgagttattttattgtatcagaattttgctatatcacatattactctaaaaagtacacatacttctggatagagcagaaattatattaaacttacccttagctcactagtatgtctcagttaacagaaattacagttacagagactgctaaaatttcaaatataatgtggtagtaccatacattgtgtcccaactagttcatctataccttaaggtgcaagttaagtattatctttgtttatgaagacatgtggtttcaaagtaagtgctaaaaaaagtgttagatgaaatcaaatggaaaaaatatgaaagatgtttaaattaagaagcattaagttttaaaaacgcatgaaagagccagagtacttgctttactaaaaggcgtgacagcactatcatttcctaaaactcaaatatcaaatccattttatttgtattttagtaggcataaaggaaaatgatcacatttgggtatataatcatatctttaattagtgagattaagaaataataaaatattgcataaatacaatagtttcagaaaattttaatgtattttaatgttttaatgtactcattacacatgtacactaaattatgtaatatattaaatttttaattaaaaaacctaaagtctagttacctctccaaattagacaatatattaccaatcccagaaatgaggagggccaatgaacacttcttttttattcttaaagagcaatttcctaatatactcgtgtacacaaatatttcatttggtcctcttaattatatatttgatactgcatccctattctacaatttaggaaagatgcaaaaaggtgaactgctcaagatcacagaactaagaaaacagggaaaccttggcagaagtttaggttttgtcactaagccacatgcacatcctctatatactgatcagcatggcttaaagtaaaccatgacactgacaaacaaaatttgaaagcccccaaatactgtaaatgatattctaaaaggcaaaaggcaaattcagagaatacaaacttctattttaattaaaagccattccactccatttaaattcaatttatgcatagcattacattcttaatagtctaaattatattctactgatcattttcaaaaccagaaatatacgaaaattacagatgcccttagttattaagcaatacctcctggaaggcaaaattcaaactaactgcacagactttaaaaaaaataacacaccccaatcaatcaaagtttccttttatttgtttcattgctaaaatactcatgccttcaattcatctgatacctaaaatccaagttaacatctcctcaaaactttcacaaaaatcacatttcgatactttattctaggttccctagaatcaagtagtctctttgtacaatttcaaagttcttacccagagtaattctgaagcatgtgttaccaaataaacacatgaaaatgaagcctggatgtacagcatactcatagtcaactgaggacctctagtgcctttgaaaaggtactccatctttagttttcaacccccaacccccgcacaaaaaaaaaggttgactaactcactcacattaatagggggtatatttattaagtggcattcattttaaatccttaagactttctcaatactacctccccatattctcttcccccagaaaagattctgaatttccaactcctacagggttaagaagaatattttacttgtaaatacacttgtaaagcattgtttcaatatttaaaaaacaataatgaaggcaaacctacagacaatatagcaacagcaataagctaaattgtcagttttagagagaaaaatatctctgtgctgttgtttaatgaattctcctcaagacagagctttaacatgagaagcacttcattatgggtcaatttaggaatgagaatatattgatttttatgcatatacaattattttcataaccagacagaagcagcttgaagattctttcaaacagccagtctggaccaacaaagctctggaatgttgctaccacaaagtaacttcaaatagaatgtccaagtttagtattaggcaatctcaaaaggaaaatgactccactggagtgaacttttgtaagccaacagattcatcgtaaatctaatgatgaactgtcctaatttattaccacaagtccaaaaaagggtatatgcacattcacttatggcttatcagtggaaatgtcagaaagtagtagaaaaataaaattccaaacaatccaaatatagacaagtcctgtttattcaatctatagaaaattctaatcttctaaaccaattagatggaaaaaacatcctagagtatatcagactgtagccttagatattacttgaattcaatttaataaagtatttcttcagtactcccatgtttactaaaagaataaacaaaattaaaaggagaaaagcaaaattctaaattctacaaacataaagaatcccaggaatttattatttcagcaaaaggaataccaccaaaaatactgaagtttgagaagttctgcaagaagtgaacatacttaaagtatagatggagattaatgctcagcatatacaacatcattaaagtatcaattgtctagcaagtcataaagcaggccaccaaaagttttcagaagactattgaggttccttccgcacaagaatgcatctgatattacattgctaaaacaggactcactgcagacaaagtaaggactcctgaaggagttgatatatagtagcttccaccaaacatgttgcctaacatggtatatgacattagtcaaaagattagagttgcctaatggcttttctatttccttcttccacctcaaaaaaaaaaccagaataccatcttgaacttgattttttttttaatttccagcgttacttttcttgaggaaaggacgacaaccaaaggatttataaatcccacaaagaatagtaaagaattctttatttttattcttctcattcccctaaaaagtagagtaatcatggatccacagacataagatactctgtggatactttcctgcctctgacatgtaactcaagagacaggagtctggcatttctacacccaaactcctaacaagcacctttcatgttttcaatactcttgattctagggcctagaagacaatttgattttaaaattcatctataaatgaataccactcttgtgtcaaaacaaccaatttatatatattgtcattcttttaataaaagggtggagagcagcttcagtttccatggttgtttaggccatatacaagttcagaaaatcccaaaactatttatgattagactaacagaatgctctaaaaagatcagataacatgaaaataaaactaaactatttttgtatgctttccatcgaaaaagtactctattaaacagcttagctgttaagaaattaaaaaaaaaaaaaaaaaggaaactcatacagtggttgtcagtgcagagaagagaatgataaacatctgacaaccatgccataaattataatgtagtaaaggtcacagacaactccaaaaataggattctgctgttcccacaacaaaggttttcaattctcaatgtatgacaggaagccccatcttctatggataaaatctggcctaattatcatcatacaaatgttggtattcagtagaactaggattccacacatttcagatgataactgtaaaaaattgagcccaataaattaaatgtatatcattaacattttagcgtgtaaagcagatttaagtttaggcataaaatcataaagtagttacaaataactttaggattatggcatatttctaaatctgacaagaaacaggatactatttttggtcatctcctttacacccaatttgtttccagaaacaaactcttctttttcaataacagttagctgttgtaggattataagatcatctttaaagtatgttaactatgctttaaacagtaaagagctcatctctttagggcatatctctgtatttcacaaatactaaaaacccatttatacaaagcctagttcaggttaatactgtgttaatcaggtaaccattaatttaggtgaatcctctaagcctcatttttctcacctgtgatagaaagagacttgaggaaaatattagagcttacatgtccaactaacaaattgttattagaactagttaatctgtcaatcacagcattatttttaaaattgtttaacttattattaaaaatgagggccaggcatggtcattcacacttgtaatcccaggaattacctgagctcaggagtttgagaccagcctgtgcagcacagtgaaaccctgtccctaccaaaaatacaaaaattagccaggcatggtggcgcacacctgtggtctcagctactcaggaggctgaggcagggagatcgctagagcctgggaagttgaggtgcagtgagccacgattgcacaactgcactccagcctgggtgacagagcaagaccctgtcagtcattcattcatccattcataaaaacaattaattaattaaaaatgagatggggtctcattatgttgcccaagctggtctcgaactcctgggctcaaacattcgtcccgcctaggccttccaaagtgttggaattatagatgtgagccaccatgccctgcccacagcattatttttaattaacaattttctaatagttttagtcataaaaatcccttatttaactttagtgatttattgaagcataccaattatgcactaagtactaggatactaaataaacacacagtttctttacttcagaaactatcagtctagctggggatacaaacatgtaaattgaaattgtgctataatctgacagatatcctcatatagataacactaaagccctattaaaaaccagtagaggtgacaaccaattccaccttaataactaatgaaaggtttcactaggaagtgatatttaaactgaaccttaagaatcaactgaagcttgcatggcagacaatcaaaaggtggagaacacattccaggcagagatagaacaacatgtgcaaagaacaaaatcacaaaagggaatggagtatttatggaaaggtgacatgtttcatgtgactgaagtacaacttaccagtgtcaacgtaggggatgactcctgtatatgcttcatgataaactcctggccaactccctcctttcccatgttttgtctcaaaataatttttaaaatttctgaccttttaagaccacttaagcccaaaaacctcacaaaaccatatgttcaaataggaattaccaagtctaattattattcctttcttaactgtattctgctacacatcttcataaaaggtgactactcggccaggtgcagtggctcacgcctgcaatcccagcactttgggaggccgaggcgggtggatcacgaggtcgggagatcgagaccatcctggctaacatggtgaaaccccgtctctactaaaaacacaaaaaaattaggcatggtggcgggcacctgtagtcccagctactcgggaggctaaggcaggagaatggcgtgaacccgggaggtggagcttgcagtgagccgagatcgtgccactgcactccagcctgggcaacacagcaagactgtctcaaaaaaaaaaaaaaaaagtgactactcaaatataaataaaatcttcccataattttccaatccactagatctacaataagcaaatatcaacataagcaaatatcaacataagcaacttaaaggatgaatctcaataaagaacaaaagaaaatctatttatattttacctgaagaattcaaacaaaagtcattaaatatatgtcaagtttaagctgctatgtcccttatttttaacttttgttttaagtttgggggtatgtgtgaaggtttgttacacaggtaaacacatgtcatggggagcttgttgtatgtattacttcatcatcccgttattaagcccagtacccaacagttttctgctcctctgcctcctcccatcctccccgctcaagtagaccccagcgtctgttgtttccttctttgtgttcataagttcttatcatcttgctcccacctgtaagtgagaacctgtggtatttggttttcttttcctatgttagtttgctagggataatgacctccagctccatccatgttcccgcaaaagacatgatatcattcttttttatggctgcatagtattgcatggtgtatatgtaccacattttctttatccagtctgtcactgatgagcacttaggccggttcatgtctttgctattgtgaatagtgctgcaatgaatattcatgggtgtatgtctttacggcagaaagatttacactcctctggatatatacccagtaatgggattgttgggtcgaatggtagttctgcttttataagctgctattttctaagtagaagtgttatagacaacctaaataacagcctttagccacctgtttagacaatgaagaatatatgctagaaaaatacaggtagttaataactctttaaggaaagaaaatttgatagaagttgagtgtttggaactccttgctacagaccaatattatgaagggggacagagtctcaagccaaaaatgcccagtctactatataattcagaatataatagacccaagttgaacactacagaatctaaacaccataaaccatatggtttctttgccaaagtaaatgccgggttctaactagtcatgcctgatacttaccttcccctttgccattctttcagcacttccttctgctcccttcagcactttcctctctcaggaatgggctaacaggttgagatgggcttttatgggatgtataaaaggacttaggagaaaataaaatctgacacctggggtaaggtagtaatatgttgattaacaataatatatcaacaaatgttaacagtcactatgtctggcagttaattactgactttttttctccgtttttcatttttcttatttcaaaattgacacataagtatactgattgaaaacaaaatgtccccaagtgttaataacgattatctctggacagttaatacagttaattttcagtctatatataatttttctgtaatgacatgtaaattcttattttattaatcatcaaagtataggccccacaggcagcaatagcttgtgggatctctgaaagaaggcatgatggaaactactactattaagtagaagtctgtaaataggatatgtctgtggtagtgagataataataattactatgtgttccaagcttgacagtcttcagtacttaacatcaaatcttattaaaatgttacttaagataacattctataaaactataaaatcataaaaaggaataacaatttgaatctatatttttggtaaaacacttcccatttaacactattttattttagattaaaattaagatccagggaacaatttgttgtatgcatttcctttttatgagattggctctggagctattaatacagtgactgatcaaaccaattacatctacagagtaacagatttaaagaaactatatgttagaacttttacccaaaagaataacccaaaacaagctgtaccttaaaccaaatacagcaggtcctcaaataacatcatttctatgtcattttgttataacatttaagtatgtgtggggcttgcatattctccccacatctgtgggactctggtttcctcccatatcccaaaacagtgcacattaggttcactggcatgtttaagttgtcctgggttgagtgtgagtgtgtacatgagtgtatcctgtgatggagtggcctcctatccaaggtgggttcctccctccttgagctgctgggattggctccagccaccagcaccccaaaccagaataagagggttgaaaaatgaatgaatggatgaatacaaattattatcgaataaaaattggtaaagtctacggtgatcatacaaatgcatgacaataaacgctatggcacaaaagcactcagagatcccaccgtatttgaattgtttttgatctgcatggagctggatgtgctcctgacaattttcatttctcaaacatgattccatgtttttaatagaccaccacaaccactgttactcactgattcaccaaatactgggtaattatctttgttggcttttttttttttttcctgggacagagttttgctctgtcacccaggctggagtacagtggcatgatctgggctcaatgcaacccctgcctcctgggctccagcgatcctcccaagtagctaggattacaggcacatgccaccagcctagctaatttttatatttttagtagagacagggtttcaccatgttggccaggctggtctcaaactcctgacctcaggggaactgcccgccttggcctcccaaagtgctgggattacaggcatgagccactgcacctggcctatctggtttttattaatctttcttaaatgtatacatagttcatatttctctcaacgtttaatattagaagtgtttggggtctttattgagaagtttggtgatgtttttgtgaccagaaatatgctataggaacttaactcttgtttacatcaatcagcctagggtaaaaatggttttgttatatgttgttttgcgtaaagtcatggtttccaggaacttatggaagacactgaggattactccaatacttgtagtaaatttgggagaaaaaggcaaggactaaagttactactcctaacacaaatgagacggtcatggtgtgccccatcaaaaaaggagagaaagagagacagacacatagaaacacgtgcacatacacacacacacacacacacacacacacacacacagagagagagagagagagagagagagagggagagagactatagaaacatgatgttataaataacaatagtgctgaggaagatgaattagtgtaaaattgtattttttgttctgaggataggttacatagatgattctaatccatttattatttttacattccaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgcagtccactctactgagctaaattatagatccagctatgctatttataattattttcttgatgaataaattttcaatttctcctctgaccatttcagaacatcttccaataactcataaaacaactgaagtaaaattgagtgctggaaaatatattcaccaaactttggtaatttaagttgactaaagtttaaaattaagtctaaaatagtttacacctatactgcataatccaacaattttaatttcagttgaagacatgttactaatataactattattaaaagagtagaggatgtgtaattaaccatatcttctaaaacatggttactaaaagaatatgtaacatcaatattgaccttggtttcttacacaagtgttgctaactcaatagtgaaggagacactattaaattttctgaacccatgagagatactagagatggggagtggaaagtgtttggttcagggatatctgaagaacagaagggcagagatttcttaagtgacgcctcatctacaagctggaaattcctaaaaacaagtagaaagcttataaacaacaggtgatacactcacctcactggttttagtaaattaccaatacagaaagtatccctagtcttaaaaacaagtggaaaatttgaactgattagtcatattcctttgattacactgtttgttacaatatttttctcagtaaacagaaataactaatttttttgttcttcattctttgatagaaattaaaatcttattctgtgaggattacagaatactataactcaaattataaagtagaataaactctttaaataattattcttcatcataaagtgtaaagaataagatataagaaaacaatttatttttaaaatttaatatactaaatgctcaaatatgttctactatagaataagttcttatcttaatttacagggcactaaaaacaattttaaaatgcttaatgttgccttttatattttaattggttaagaatatatatttgtttaatgcaaatcagaatcactatattaaaatgaatgttcttgaaaactcagtggggctgctctataatacacttacaattgatactaacgataaaacgctctaattatagttttaattttataggggtttttttggtgactttccccaaataaaacaaaatcaagacgcccaagtccagacacacaagagggcagacgtatataagataacaaattgctactacatagcgattatttatcttttgattatttttgagacttctggcaaagtaggactataataaattttcagaaaagatctgctcttctgctaagtaacagcacacttcaaaatgtccagaaattttatgctaatattacatagaaaacttgacagatgaaaaaagtgaaacacattactaattttattcattaaaacaggtatataaaagtcctctttaactacctaatgaatgtgtcatatcctaatatagggagtgtcatagtgttcacatctttgaatatataaattatctcaaacagttaaaaaattaaagccagaacagggtacaaaaataagaataaaaataagaaaactttctgttcacaggacgtaacagaatactttaaacactctcaagttataaataaaactttttcattattatttcatgttagacaaaaaacaagtcattttactttaactcattttatcaattttttttttttaaatcaagagacagggtgttactctgtcatgcaggctggaatgcagtcacatgatcattgcacactgcagccttgaactcttggggtgcaaaggattctccaaccttggttcccaagtagctggcactacaggggcacatcaccatatatggctaattctttttattttttgtagagatggggtctcattgcccaggctggtcccaaactcctatcctcaagctatccaccccccatcagcctcccaaagtgttgggattacaggggtgagctaccatgcttggtccaaattttttgtttatacaagggaaaatctccagtaaaatatgtataggtgccaataccataactgttcaaacacccttatgactaaataggcacaaaatttcatctttttaatgactgccacctgaagttcagaaacatcctagggaaaaaaggataaacaacttcatcaataaagaggctactattatttcactactgtctgggagatccatcgtgggcttacaggaatccaaatggatactgccgttacgtgtagaagtgtttatcctccatcccttccaccctaccttccccaagaaaaggaactcaagggggccatggaaagggaaggagtcttcccaaaaagaccagactgtttttcctcctctgtcatagtccctatagagtcaggcagcttaggggttgcagggggtgggtagcataagtgtgatgtactaccgaggaaagagtcaaagactagcagtaggcattacacatggagccttctgtcataaaccatctgagggcataatggcttcttttcattcacaaaggaaaatgattcagagtactacactcctgcactcttgatgatttagcagaaaaccatggaaatcaaggaacaacacacacataagaatgtgtgtctggctcaataattattctggactaagtcctaggaagagcaaaccttcaatgttacaaattaacctggggagtggggagctgtgagaatcaaatgagataaaatactgtgaaagctacagaattctataacatataaatctaaggttttattagattatgactttcagccaaattccttttcttagttgtaaaaatattgttttttcatggtgagtgtttaggagttgtgcttgcaaatcacaatttatcagacggcctggtccttattaaggttcttctctttatgtaaaaattagactaaaagaaaatcagtgtttctatgatttttatcttttttcctttttagagacggggtctggccatgttgcccaggctagtctcaaactcctggactcaggcaattctcctgccttggcctcccaaattgctgggattacaggcgtgcgctacagtgcctggccagaagtcaatgtttcaaagaggcttttaagaaacaactatgatgaaagcttttaaaataaagataatactacttggaggctccaagaaggtatttaacaacttttttctgtagttttctaaggaggaaattagaagggaagcagtcatttaatgattacaacttagtttgtctagttttctttacctgaattcatctttctactccaaaacttaaaagcgctataaagagaccatcccaaataaagttaatcaagaagtagggctttccagggtatatgcaaattttgctctttagttgccttctctctctactatgcactagaaagaagatttaaaaacaaatttatctcaacagtgtgtccccaacctccctaccctcctctgcattgctttgaggctaagaaaaacaccttgtttaaaccagagatttgtccaagcagaataaaaagcatgaatcagtatttactccttgaaatttgcccaattatctctatcacacctactctagtttggaatagcatactcagccccactggacagctccaattctgtgtaaagacaccagctggagaaacaactgcctggatctctgttttcctataatgacaaacatttgaaaactaaaacttgacagtatttgaaaaattaggtttcctatttttcatcacttgaatggataaatcacaaatttctaattcaatcataatgattcttctgttttgattgtgttgtttaaatacataatcaaaattataagaactgtatctaaaataagaataaaggtacatgcgacatgttaagggttctcctatgaatgtagtatgttagggttctatgttttgagatcatactcatatttgtgaggttcctggacaagtgatttccttatcctttcatagcctatgttcatttattctatttgtttttattagtagtagtaatgaataccaattttacatttttactctagggaaaatttgcaattttttatagaattaatttgtttcagaaaattctgatgataaaaaacagatgacaggacttatatcagaaaattagtttccttgttaaaacaagctacagaaaattgtcttggaatagaaacattcccagattaagaaatttacacatttacatgctattccctagaccaactgggggctgtatactatttttctttatatatgatatcatcataaagcactttctataagctgattaatgaatgccttgacacataatttttttt

SEQ ID NO: 3-5 - skipped (3 entries)

SEQ ID NO: 6 - DNA, 19 bp, Artificial sequence
  Primer
tgatgatcacagctgccaa

SEQ ID NO: 7 - DNA, 22 bp, Artificial sequence
  Primer
gactttctccatgataccagca

SEQ ID NO: 8 - DNA, 31 bp, Artificial sequence
  Probe
ctctcgaccacttaaaacttcagacttcctg

SEQ ID NO: 9 - DNA, 20 bp, Artificial sequence
  Primer
ggcaaattcaacggcacagt

SEQ ID NO: 10 - DNA, 20 bp, Artificial sequence
  Primer
gggtctcgctcctggaagat

SEQ ID NO: 11 - DNA, 27 bp, Artificial sequence
  Probe
aaggccgagaatgggaagcttgtcatc

SEQ ID NO: 12 - DNA, 25 bp, Artificial sequence
  Primer
cacccgtaagacttcatacaacaca

SEQ ID NO: 13 - DNA, 25 bp, Artificial sequence
  Primer
tggcagccaaatatgagataactgt

SEQ ID NO: 14 - DNA, 16 bp, Artificial sequence
  Probe
tgccaaggctacctaa

SEQ ID NO: 15 - DNA, 16 bp, Artificial sequence
  Synthetic oligonucletide
tgggaacagttgcagt

SEQ ID NO: 16 - DNA, 16 bp, Artificial sequence
  Synthetic oligonucletide
agtttatgggaacagt

SEQ ID NO: 17 - DNA, 16 bp, Artificial sequence
  Synthetic oligonucletide
agtcttacgggtgttt

SEQ ID NO: 18 - DNA, 16 bp, Artificial sequence
  Synthetic oligonucletide
cagtatagagtattgt

SEQ ID NO: 19 - DNA, 16 bp, Artificial sequence
  Synthetic oligonucletide
cttttaggtagccttg

SEQ ID NO: 20 - DNA, 16 bp, Artificial sequence
  Synthetic oligonucletide
ttttaagtggtcgaga

SEQ ID NO: 21 - DNA, 16 bp, Artificial sequence
  Synthetic oligonucletide
gataccagcaggacag

SEQ ID NO: 22 - DNA, 16 bp, Artificial sequence
  Synthetic oligonucletide
tgagcgagtgaggtat

SEQ ID NO: 23 - DNA, 16 bp, Artificial sequence
  Synthetic oligonucletide
tagctgagcgagtgag

SEQ ID NO: 24 - DNA, 16 bp, Artificial sequence
  Synthetic oligonucletide
cttatagctgagcgag

SEQ ID NO: 25 - DNA, 16 bp, Artificial sequence
  Synthetic oligonucletide
gaggctcttcttatag

SEQ ID NO: 26 - DNA, 16 bp, Artificial sequence
  Synthetic oligonucletide
tggttgaggctcttct

SEQ ID NO: 27 - DNA, 16 bp, Artificial sequence
  Synthetic oligonucletide
tcaatggttgaggctc

SEQ ID NO: 28 - DNA, 16 bp, Artificial sequence
  Synthetic oligonucletide
catttcaatggttgag

SEQ ID NO: 29 - DNA, 16 bp, Artificial sequence
  Synthetic oligonucletide
gaggcatttcaatggt

SEQ ID NO: 30 - DNA, 16 bp, Artificial sequence
  Synthetic oligonucletide
atcacgatgatacaga

SEQ ID NO: 31 - DNA, 16 bp, Artificial sequence
  Synthetic oligonucletide
tagaggttgtagcaga

SEQ ID NO: 32 - DNA, 16 bp, Artificial sequence
  Synthetic oligonucletide
gcagatctagaggttg

SEQ ID NO: 33 - DNA, 16 bp, Artificial sequence
  Synthetic oligonucletide
gtttacaagatccaac

SEQ ID NO: 34 - DNA, 16 bp, Artificial sequence
  Synthetic oligonucletide
gatacttggtgaagac

SEQ ID NO: 35 - DNA, 16 bp, Artificial sequence
  Synthetic oligonucletide
tctgatagttactaca

SEQ ID NO: 36 - DNA, 16 bp, Artificial sequence
  Synthetic oligonucletide
gtaagagtatggcctt

SEQ ID NO: 37 - DNA, 16 bp, Artificial sequence
  Synthetic oligonucletide
gtactagaattctgtg

SEQ ID NO: 38 - DNA, 16 bp, Artificial sequence
  Synthetic oligonucletide
atattaaccaccagtt

SEQ ID NO: 39 - DNA, 16 bp, Artificial sequence
  Synthetic oligonucletide
tcacatattaaccacc

SEQ ID NO: 40 - DNA, 16 bp, Artificial sequence
  Synthetic oligonucletide
attagtgatatgacta

SEQ ID NO: 41 - DNA, 16 bp, Artificial sequence
  Synthetic oligonucletide
ttagtatattagtgat

SEQ ID NO: 42 - DNA, 16 bp, Artificial sequence
  Synthetic oligonucletide
taattcactacagtgc

SEQ ID NO: 43 - DNA, 16 bp, Artificial sequence
  Synthetic oligonucletide
ctaggtaactctagct

SEQ ID NO: 44 - DNA, 16 bp, Artificial sequence
  Synthetic oligonucletide
atagtatggtaagcta

SEQ ID NO: 45 - DNA, 16 bp, Artificial sequence
  Synthetic oligonucletide
aagatatagtatggta

SEQ ID NO: 46 - DNA, 16 bp, Artificial sequence
  Synthetic oligonucletide
tgttaggctggaatgg

SEQ ID NO: 47 - DNA, 16 bp, Artificial sequence
  Synthetic oligonucletide
aatagatgggccaaca

SEQ ID NO: 48 - DNA, 16 bp, Artificial sequence
  Synthetic oligonucletide
ctgtagatgtaataga

SEQ ID NO: 49 - DNA, 16 bp, Artificial sequence
  Synthetic oligonucletide
ccacgaattgtcagct

SEQ ID NO: 50 - DNA, 16 bp, Artificial sequence
  Synthetic oligonucletide
attttgcggacccacg

SEQ ID NO: 51 - DNA, 16 bp, Artificial sequence
  Synthetic oligonucletide
gttaagattttgcgga

SEQ ID NO: 52 - DNA, 16 bp, Artificial sequence
  Synthetic oligonucletide
ggctattaggtagtta

SEQ ID NO: 53 - DNA, 16 bp, Artificial sequence
  Synthetic oligonucletide
gtaaggtttatggtca

SEQ ID NO: 54 - DNA, 16 bp, Artificial sequence
  Synthetic oligonucletide
acatataacacgcaaa

SEQ ID NO: 55 - DNA, 16 bp, Artificial sequence
  Synthetic oligonucletide
cttttatgttgaccca

SEQ ID NO: 56 - DNA, 16 bp, Artificial sequence
  Synthetic oligonucletide
acccctaagacaagac

SEQ ID NO: 57 - DNA, 16 bp, Artificial sequence
  Synthetic oligonucletide
tcctattacagttgac

SEQ ID NO: 58 - DNA, 16 bp, Artificial sequence
  Synthetic oligonucletide
aaatagatgcttacca

SEQ ID NO: 59 - DNA, 16 bp, Artificial sequence
  Synthetic oligonucletide
atttagctcagtagag

SEQ ID NO: 60 - DNA, 16 bp, Artificial sequence
  Synthetic oligonucletide
atagcatagctggatc

SEQ ID NO: 61 - DNA, 16 bp, Artificial sequence
  Synthetic oligonucletide
agtataggtgtaaact

SEQ ID NO: 62 - DNA, 16 bp, Artificial sequence
  Synthetic oligonucletide
tagtaacatgtcttca

SEQ ID NO: 63 - DNA, 16 bp, Artificial sequence
  Synthetic oligonucletide
aattacacatcctcta

SEQ ID NO: 64 - DNA, 16 bp, Artificial sequence
  Synthetic oligonucletide
cttttagtaaccatgt

SEQ ID NO: 65 - DNA, 16 bp, Artificial sequence
  Synthetic oligonucletide
agcaacacttgtgtaa

SEQ ID NO: 66 - DNA, 16 bp, Artificial sequence
  Synthetic oligonucletide
attgagttagcaacac

SEQ ID NO: 67 - DNA, 16 bp, Artificial sequence
  Synthetic oligonucletide
tcactattgagttagc

SEQ ID NO: 68 - DNA, 16 bp, Artificial sequence
  Synthetic oligonucletide
gtgtatcacctgttgt

SEQ ID NO: 69 - DNA, 16 bp, Artificial sequence
  Synthetic oligonucletide
ttaagactagggatac

SEQ ID NO: 70 - DNA, 16 bp, Artificial sequence
  Synthetic oligonucletide
gtttttagtgccctgt

SEQ ID NO: 71 - DNA, 16 bp, Artificial sequence
  Synthetic oligonucletide
gatgtaaatagctcag

SEQ ID NO: 72 - DNA, 16 bp, Artificial sequence
  Synthetic oligonucletide
gatacctcagtggtag

SEQ ID NO: 73 - DNA, 16 bp, Artificial sequence
  Synthetic oligonucletide
aaggtatagatgaact

SEQ ID NO: 74 - DNA, 16 bp, Artificial sequence
  Synthetic oligonucletide
agtatatagaggatgt

SEQ ID NO: 75 - DNA, 16 bp, Artificial sequence
  Synthetic oligonucletide
ctgggtaagaactttg

SEQ ID NO: 76 - DNA, 16 bp, Artificial sequence
  Synthetic oligonucletide
cttcttaaccctgtag

SEQ ID NO: 77 - DNA, 16 bp, Artificial sequence
  Synthetic oligonucletide
cttttttggacttgtg

SEQ ID NO: 78 - DNA, 16 bp, Artificial sequence
  Synthetic oligonucletide
gtaatatcagatgcat

SEQ ID NO: 79 - DNA, 16 bp, Artificial sequence
  Synthetic oligonucletide
gatgataattaggcca

SEQ ID NO: 80 - DNA, 16 bp, Artificial sequence
  Synthetic oligonucletide
caatttgttagttgga

SEQ ID NO: 81 - DNA, 16 bp, Artificial sequence
  Synthetic oligonucletide
tagtatcctagtactt

SEQ ID NO: 82 - DNA, 16 bp, Artificial sequence
  Synthetic oligonucletide
gtttttaatagggctt

SEQ ID NO: 83 - DNA, 16 bp, Artificial sequence
  Synthetic oligonucletide
agcatatacaggagtc

SEQ ID NO: 84 - DNA, 16 bp, Artificial sequence
  Synthetic oligonucletide
agttattaactacctg

SEQ ID NO: 85 - DNA, 16 bp, Artificial sequence
  Synthetic oligonucletide
ccttttatacatccca

SEQ ID NO: 86 - DNA, 16 bp, Artificial sequence
  Synthetic oligonucletide
gtaattaactgccaga

SEQ ID NO: 87 - DNA, 16 bp, Artificial sequence
  Synthetic oligonucletide
ctgtattaactgtcca

SEQ ID NO: 88 - DNA, 16 bp, Artificial sequence
  Synthetic oligonucletide
ggagaatatgcaagcc

SEQ ID NO: 89 - DNA, 16 bp, Artificial sequence
  Synthetic oligonucletide
ttccataagttcctgg

SEQ ID NO: 90 - DNA, 16 bp, Artificial sequence
  Synthetic oligonucletide
gcatttcaatggttga

SEQ ID NO: 91 - DNA, 16 bp, Artificial sequence
  Synthetic oligonucletide
catgtttacaagatcc

SEQ ID NO: 92 - DNA, 16 bp, Artificial sequence
  Synthetic oligonucletide
atgggaacagttgcag

SEQ ID NO: 93 - DNA, 16 bp, Artificial sequence
  Synthetic oligonucletide
cagtttatgggaacag

SEQ ID NO: 94 - DNA, 16 bp, Artificial sequence
  Synthetic oligonucletide
tatgaagtcttacggg

SEQ ID NO: 95 - DNA, 16 bp, Artificial sequence
  Synthetic oligonucletide
acagtatagagtattg

SEQ ID NO: 96 - DNA, 16 bp, Artificial sequence
  Synthetic oligonucletide
tcttttaggtagcctt

SEQ ID NO: 97 - DNA, 16 bp, Artificial sequence
  Synthetic oligonucletide
gttttaagtggtcgag

SEQ ID NO: 98 - DNA, 16 bp, Artificial sequence
  Synthetic oligonucletide
gtattggactttctcc

SEQ ID NO: 99 - DNA, 16 bp, Artificial sequence
  Synthetic oligonucletide
ctgagcgagtgaggta

SEQ ID NO: 100 - DNA, 16 bp, Artificial sequence
  Synthetic oligonucletide
atagctgagcgagtga

SEQ ID NO: 101 - DNA, 16 bp, Artificial sequence
  Synthetic oligonucletide
tcttatagctgagcga

SEQ ID NO: 102 - DNA, 16 bp, Artificial sequence
  Synthetic oligonucletide
tgaggctcttcttata

SEQ ID NO: 103 - DNA, 16 bp, Artificial sequence
  Synthetic oligonucletide
atggttgaggctcttc

SEQ ID NO: 104 - DNA, 16 bp, Artificial sequence
  Synthetic oligonucletide
ttcaatggttgaggct

SEQ ID NO: 105 - DNA, 16 bp, Artificial sequence
  Synthetic oligonucletide
cagcaagagacatatt

SEQ ID NO: 106 - DNA, 16 bp, Artificial sequence
  Synthetic oligonucletide
aagcatcacgatgata

SEQ ID NO: 107 - DNA, 16 bp, Artificial sequence
  Synthetic oligonucletide
ctagaggttgtagcag

SEQ ID NO: 108 - DNA, 16 bp, Artificial sequence
  Synthetic oligonucletide
tggcaagctgcagatc

SEQ ID NO: 109 - DNA, 16 bp, Artificial sequence
  Synthetic oligonucletide
tgatacttggtgaaga

SEQ ID NO: 110 - DNA, 16 bp, Artificial sequence
  Synthetic oligonucletide
ttctgatagttactac

SEQ ID NO: 111 - DNA, 16 bp, Artificial sequence
  Synthetic oligonucletide
atgtaagagtatggcc

SEQ ID NO: 112 - DNA, 16 bp, Artificial sequence
  Synthetic oligonucletide
atgtactagaattctg

SEQ ID NO: 113 - DNA, 16 bp, Artificial sequence
  Synthetic oligonucletide
catattaaccaccagt

SEQ ID NO: 114 - DNA, 16 bp, Artificial sequence
  Synthetic oligonucletide
actaatctcactgtca

SEQ ID NO: 115 - DNA, 16 bp, Artificial sequence
  Synthetic oligonucletide
tattagtgatatgact

SEQ ID NO: 116 - DNA, 16 bp, Artificial sequence
  Synthetic oligonucletide
gttagtatattagtga

SEQ ID NO: 117 - DNA, 16 bp, Artificial sequence
  Synthetic oligonucletide
gataattcactacagt

SEQ ID NO: 118 - DNA, 16 bp, Artificial sequence
  Synthetic oligonucletide
gctaggtaactctagc

SEQ ID NO: 119 - DNA, 16 bp, Artificial sequence
  Synthetic oligonucletide
tatagtatggtaagct

SEQ ID NO: 120 - DNA, 16 bp, Artificial sequence
  Synthetic oligonucletide
aaagatatagtatggt

SEQ ID NO: 121 - DNA, 16 bp, Artificial sequence
  Synthetic oligonucletide
gcattggatgttaggc

SEQ ID NO: 122 - DNA, 16 bp, Artificial sequence
  Synthetic oligonucletide
gtaatagatgggccaa

SEQ ID NO: 123 - DNA, 16 bp, Artificial sequence
  Synthetic oligonucletide
gctgtagatgtaatag

SEQ ID NO: 124 - DNA, 16 bp, Artificial sequence
  Synthetic oligonucletide
cccacgaattgtcagc

SEQ ID NO: 125 - DNA, 16 bp, Artificial sequence
  Synthetic oligonucletide
gattttgcggacccac

SEQ ID NO: 126 - DNA, 16 bp, Artificial sequence
  Synthetic oligonucletide
attaggtagttaagat

SEQ ID NO: 127 - DNA, 16 bp, Artificial sequence
  Synthetic oligonucletide
aggctattaggtagtt

SEQ ID NO: 128 - DNA, 16 bp, Artificial sequence
  Synthetic oligonucletide
agtaaggtttatggtc

SEQ ID NO: 129 - DNA, 16 bp, Artificial sequence
  Synthetic oligonucletide
tacatataacacgcaa

SEQ ID NO: 130 - DNA, 16 bp, Artificial sequence
  Synthetic oligonucletide
cctaagacaagactgc

SEQ ID NO: 131 - DNA, 16 bp, Artificial sequence
  Synthetic oligonucletide
ttgcaagggtccactt

SEQ ID NO: 132 - DNA, 16 bp, Artificial sequence
  Synthetic oligonucletide
atcctattacagttga

SEQ ID NO: 133 - DNA, 16 bp, Artificial sequence
  Synthetic oligonucletide
cagtagagtggactgc

SEQ ID NO: 134 - DNA, 16 bp, Artificial sequence
  Synthetic oligonucletide
aatttagctcagtaga

SEQ ID NO: 135 - DNA, 16 bp, Artificial sequence
  Synthetic oligonucletide
gagttattggaagatg

SEQ ID NO: 136 - DNA, 16 bp, Artificial sequence
  Synthetic oligonucletide
gcagtataggtgtaaa

SEQ ID NO: 137 - DNA, 16 bp, Artificial sequence
  Synthetic oligonucletide
ttagtaacatgtcttc

SEQ ID NO: 138 - DNA, 16 bp, Artificial sequence
  Synthetic oligonucletide
ggttaattacacatcc

SEQ ID NO: 139 - DNA, 16 bp, Artificial sequence
  Synthetic oligonucletide
tcttttagtaaccatg

SEQ ID NO: 140 - DNA, 16 bp, Artificial sequence
  Synthetic oligonucletide
tagcaacacttgtgta

SEQ ID NO: 141 - DNA, 16 bp, Artificial sequence
  Synthetic oligonucletide
ctattgagttagcaac

SEQ ID NO: 142 - DNA, 16 bp, Artificial sequence
  Synthetic oligonucletide
tagtatctctcatggg

SEQ ID NO: 143 - DNA, 16 bp, Artificial sequence
  Synthetic oligonucletide
gtattggtaatttact

SEQ ID NO: 144 - DNA, 16 bp, Artificial sequence
  Synthetic oligonucletide
ttgtaacaaacagtgt

SEQ ID NO: 145 - DNA, 16 bp, Artificial sequence
  Synthetic oligonucletide
aggcaacattaagcat

SEQ ID NO: 146 - DNA, 16 bp, Artificial sequence
  Synthetic oligonucletide
gctgataatgtgcatg

SEQ ID NO: 147 - DNA, 16 bp, Artificial sequence
  Synthetic oligonucletide
taggatacctcagtgg

SEQ ID NO: 148 - DNA, 16 bp, Artificial sequence
  Synthetic oligonucletide
atacttaacttgcacc

SEQ ID NO: 149 - DNA, 16 bp, Artificial sequence
  Synthetic oligonucletide
tcagtatatagaggat

SEQ ID NO: 150 - DNA, 16 bp, Artificial sequence
  Synthetic oligonucletide
agaattactctgggta

SEQ ID NO: 151 - DNA, 16 bp, Artificial sequence
  Synthetic oligonucletide
agttactttgtggtag

SEQ ID NO: 152 - DNA, 16 bp, Artificial sequence
  Synthetic oligonucletide
gtaatatctaaggcta

SEQ ID NO: 153 - DNA, 16 bp, Artificial sequence
  Synthetic oligonucletide
tactatatatcaactc

SEQ ID NO: 154 - DNA, 16 bp, Artificial sequence
  Synthetic oligonucletide
taatttattgggctca

SEQ ID NO: 155 - DNA, 16 bp, Artificial sequence
  Synthetic oligonucletide
agattaactagttcta

SEQ ID NO: 156 - DNA, 16 bp, Artificial sequence
  Synthetic oligonucletide
gaggatatctgtcaga

SEQ ID NO: 157 - DNA, 16 bp, Artificial sequence
  Synthetic oligonucletide
gtggaattggttgtca

SEQ ID NO: 158 - DNA, 16 bp, Artificial sequence
  Synthetic oligonucletide
aagcatatacaggagt

SEQ ID NO: 159 - DNA, 16 bp, Artificial sequence
  Synthetic oligonucletide
tcataatattggtctg

SEQ ID NO: 160 - DNA, 16 bp, Artificial sequence
  Synthetic oligonucletide
attactaccttacccc

SEQ ID NO: 161 - DNA, 16 bp, Artificial sequence
  Synthetic oligonucletide
agtaattaactgccag

SEQ ID NO: 162 - DNA, 16 bp, Artificial sequence
  Synthetic oligonucletide
tcctatttacagactt

SEQ ID NO: 163 - DNA, 16 bp, Artificial sequence
  Synthetic oligonucletide
ttcgataataatttgt

SEQ ID NO: 164 - DNA, 16 bp, Artificial sequence
  Synthetic oligonucletide
gtattggagtaatcct

SEQ ID NO: 165 - DNA, 16 bp, Artificial sequence
  Synthetic oligonucletide
ttatgggaacagttgc

SEQ ID NO: 166 - DNA, 16 bp, Artificial sequence
  Synthetic oligonucletide
tacgggtgtttagctg

SEQ ID NO: 167 - DNA, 16 bp, Artificial sequence
  Synthetic oligonucletide
gtatgaagtcttacgg

SEQ ID NO: 168 - DNA, 16 bp, Artificial sequence
  Synthetic oligonucletide
aggtagccttggcagc

SEQ ID NO: 169 - DNA, 16 bp, Artificial sequence
  Synthetic oligonucletide
ttcttttaggtagcct

SEQ ID NO: 170 - DNA, 16 bp, Artificial sequence
  Synthetic oligonucletide
agttttaagtggtcga

SEQ ID NO: 171 - DNA, 16 bp, Artificial sequence
  Synthetic oligonucletide
gaggtattggactttc

SEQ ID NO: 172 - DNA, 16 bp, Artificial sequence
  Synthetic oligonucletide
gctgagcgagtgaggt

SEQ ID NO: 173 - DNA, 16 bp, Artificial sequence
  Synthetic oligonucletide
tatagctgagcgagtg

SEQ ID NO: 174 - DNA, 16 bp, Artificial sequence
  Synthetic oligonucletide
ttcttatagctgagcg

SEQ ID NO: 175 - DNA, 16 bp, Artificial sequence
  Synthetic oligonucletide
gttgaggctcttctta

SEQ ID NO: 176 - DNA, 16 bp, Artificial sequence
  Synthetic oligonucletide
aatggttgaggctctt

SEQ ID NO: 177 - DNA, 16 bp, Artificial sequence
  Synthetic oligonucletide
tttcaatggttgaggc

SEQ ID NO: 178 - DNA, 16 bp, Artificial sequence
  Synthetic oligonucletide
ggcatttcaatggttg

SEQ ID NO: 179 - DNA, 16 bp, Artificial sequence
  Synthetic oligonucletide
gatgatacagatcagc

SEQ ID NO: 180 - DNA, 16 bp, Artificial sequence
  Synthetic oligonucletide
agagaagcatcacgat

SEQ ID NO: 181 - DNA, 16 bp, Artificial sequence
  Synthetic oligonucletide
atctagaggttgtagc

SEQ ID NO: 182 - DNA, 16 bp, Artificial sequence
  Synthetic oligonucletide
tcaggaagtggtctgt

SEQ ID NO: 183 - DNA, 16 bp, Artificial sequence
  Synthetic oligonucletide
tgggatagaaatttgt

SEQ ID NO: 184 - DNA, 16 bp, Artificial sequence
  Synthetic oligonucletide
ctttgatacttggtga

SEQ ID NO: 185 - DNA, 16 bp, Artificial sequence
  Synthetic oligonucletide
ccatacttgattctca

SEQ ID NO: 186 - DNA, 16 bp, Artificial sequence
  Synthetic oligonucletide
tatgtaagagtatggc

SEQ ID NO: 187 - DNA, 16 bp, Artificial sequence
  Synthetic oligonucletide
acctacatgtactaga

SEQ ID NO: 188 - DNA, 16 bp, Artificial sequence
  Synthetic oligonucletide
acatattaaccaccag

SEQ ID NO: 189 - DNA, 16 bp, Artificial sequence
  Synthetic oligonucletide
atgactaatctcactg

SEQ ID NO: 190 - DNA, 16 bp, Artificial sequence
  Synthetic oligonucletide
atattagtgatatgac

SEQ ID NO: 191 - DNA, 16 bp, Artificial sequence
  Synthetic oligonucletide
gattagattctgttgt

SEQ ID NO: 192 - DNA, 16 bp, Artificial sequence
  Synthetic oligonucletide
ctctagctcagataat

SEQ ID NO: 193 - DNA, 16 bp, Artificial sequence
  Synthetic oligonucletide
agctaggtaactctag

SEQ ID NO: 194 - DNA, 16 bp, Artificial sequence
  Synthetic oligonucletide
atatagtatggtaagc

SEQ ID NO: 195 - DNA, 16 bp, Artificial sequence
  Synthetic oligonucletide
cttaaggtttcatgat

SEQ ID NO: 196 - DNA, 16 bp, Artificial sequence
  Synthetic oligonucletide
ctgcattggatgttag

SEQ ID NO: 197 - DNA, 16 bp, Artificial sequence
  Synthetic oligonucletide
tgtaatagatgggcca

SEQ ID NO: 198 - DNA, 16 bp, Artificial sequence
  Synthetic oligonucletide
gaattgtcagctcccc

SEQ ID NO: 199 - DNA, 16 bp, Artificial sequence
  Synthetic oligonucletide
acccacgaattgtcag

SEQ ID NO: 200 - DNA, 16 bp, Artificial sequence
  Synthetic oligonucletide
taagattttgcggacc

SEQ ID NO: 201 - DNA, 16 bp, Artificial sequence
  Synthetic oligonucletide
tattaggtagttaaga

SEQ ID NO: 202 - DNA, 16 bp, Artificial sequence
  Synthetic oligonucletide
gtttatggtcaatagt

SEQ ID NO: 203 - DNA, 16 bp, Artificial sequence
  Synthetic oligonucletide
atcagtaaggtttatg

SEQ ID NO: 204 - DNA, 16 bp, Artificial sequence
  Synthetic oligonucletide
taggaatatagtgtat

SEQ ID NO: 205 - DNA, 16 bp, Artificial sequence
  Synthetic oligonucletide
ccctaagacaagactg

SEQ ID NO: 206 - DNA, 16 bp, Artificial sequence
  Synthetic oligonucletide
gaattgcaagggtcca

SEQ ID NO: 207 - DNA, 16 bp, Artificial sequence
  Synthetic oligonucletide
agctatatcctattac

SEQ ID NO: 208 - DNA, 16 bp, Artificial sequence
  Synthetic oligonucletide
tcagtagagtggactg

SEQ ID NO: 209 - DNA, 16 bp, Artificial sequence
  Synthetic oligonucletide
taatttagctcagtag

SEQ ID NO: 210 - DNA, 16 bp, Artificial sequence
  Synthetic oligonucletide
cagcactcaattttac

SEQ ID NO: 211 - DNA, 16 bp, Artificial sequence
  Synthetic oligonucletide
ggattatgcagtatag

SEQ ID NO: 212 - DNA, 16 bp, Artificial sequence
  Synthetic oligonucletide
attagtaacatgtctt

SEQ ID NO: 213 - DNA, 16 bp, Artificial sequence
  Synthetic oligonucletide
atatggttaattacac

SEQ ID NO: 214 - DNA, 16 bp, Artificial sequence
  Synthetic oligonucletide
aaccaaggtcaatatt

SEQ ID NO: 215 - DNA, 16 bp, Artificial sequence
  Synthetic oligonucletide
agttagcaacacttgt

SEQ ID NO: 216 - DNA, 16 bp, Artificial sequence
  Synthetic oligonucletide
actattgagttagcaa

SEQ ID NO: 217 - DNA, 16 bp, Artificial sequence
  Synthetic oligonucletide
gatatccctgaaccaa

SEQ ID NO: 218 - DNA, 16 bp, Artificial sequence
  Synthetic oligonucletide
agactagggatacttt

SEQ ID NO: 219 - DNA, 16 bp, Artificial sequence
  Synthetic oligonucletide
ttctatagtagaacat

SEQ ID NO: 220 - DNA, 16 bp, Artificial sequence
  Synthetic oligonucletide
atatagtgattctgat

SEQ ID NO: 221 - DNA, 16 bp, Artificial sequence
  Synthetic oligonucletide
attaccaaagtcagcg

SEQ ID NO: 222 - DNA, 16 bp, Artificial sequence
  Synthetic oligonucletide
aggcattaataggcag

SEQ ID NO: 223 - DNA, 16 bp, Artificial sequence
  Synthetic oligonucletide
cacaattaggatacct

SEQ ID NO: 224 - DNA, 16 bp, Artificial sequence
  Synthetic oligonucletide
gaaatgatagtgctgt

SEQ ID NO: 225 - DNA, 16 bp, Artificial sequence
  Synthetic oligonucletide
agtatcgaaatgtgat

SEQ ID NO: 226 - DNA, 16 bp, Artificial sequence
  Synthetic oligonucletide
cctattaatgtgagtg

SEQ ID NO: 227 - DNA, 16 bp, Artificial sequence
  Synthetic oligonucletide
tttacgatgaatctgt

SEQ ID NO: 228 - DNA, 16 bp, Artificial sequence
  Synthetic oligonucletide
agtaatatctaaggct

SEQ ID NO: 229 - DNA, 16 bp, Artificial sequence
  Synthetic oligonucletide
cttgtatatggcctaa

SEQ ID NO: 230 - DNA, 16 bp, Artificial sequence
  Synthetic oligonucletide
ttaatttattgggctc

SEQ ID NO: 231 - DNA, 16 bp, Artificial sequence
  Synthetic oligonucletide
cagattaactagttct

SEQ ID NO: 232 - DNA, 16 bp, Artificial sequence
  Synthetic oligonucletide
tgaggatatctgtcag

SEQ ID NO: 233 - DNA, 16 bp, Artificial sequence
  Synthetic oligonucletide
attagttattaaggtg

SEQ ID NO: 234 - DNA, 16 bp, Artificial sequence
  Synthetic oligonucletide
ttattgtagatctagt

SEQ ID NO: 235 - DNA, 16 bp, Artificial sequence
  Synthetic oligonucletide
tatagtagactgggca

SEQ ID NO: 236 - DNA, 16 bp, Artificial sequence
  Synthetic oligonucletide
catattactaccttac

SEQ ID NO: 237 - DNA, 16 bp, Artificial sequence
  Synthetic oligonucletide
cagtatacttatgtgt

SEQ ID NO: 238 - DNA, 16 bp, Artificial sequence
  Synthetic oligonucletide
gtaattggtttgatca

SEQ ID NO: 239 - DNA, 16 bp, Artificial sequence
  Synthetic oligonucletide
attcgataataatttg

SEQ ID NO: 240 - DNA, 16 bp, Artificial sequence
  Synthetic oligonucletide
agtagtaactttagtc

SEQ ID NO: 241 - DNA, 16 bp, Artificial sequence
  Synthetic oligonucletide
agtgaggtattggact

SEQ ID NO: 242 - DNA, 16 bp, Artificial sequence
  Synthetic oligonucletide
gtttatgggaacagtt

SEQ ID NO: 243 - DNA, 16 bp, Artificial sequence
  Synthetic oligonucletide
cttacgggtgtttagc

SEQ ID NO: 244 - DNA, 16 bp, Artificial sequence
  Synthetic oligonucletide
gtatagagtattgtgt

SEQ ID NO: 245 - DNA, 16 bp, Artificial sequence
  Synthetic oligonucletide
tttaggtagccttggc

SEQ ID NO: 246 - DNA, 16 bp, Artificial sequence
  Synthetic oligonucletide
tggtcgagagaaagat

SEQ ID NO: 247 - DNA, 16 bp, Artificial sequence
  Synthetic oligonucletide
aagttttaagtggtcg

SEQ ID NO: 248 - DNA, 16 bp, Artificial sequence
  Synthetic oligonucletide
agctgagcgagtgagg

SEQ ID NO: 249 - DNA, 16 bp, Artificial sequence
  Synthetic oligonucletide
ttatagctgagcgagt

SEQ ID NO: 250 - DNA, 16 bp, Artificial sequence
  Synthetic oligonucletide
aggctcttcttatagc

SEQ ID NO: 251 - DNA, 16 bp, Artificial sequence
  Synthetic oligonucletide
ggttgaggctcttctt

SEQ ID NO: 252 - DNA, 16 bp, Artificial sequence
  Synthetic oligonucletide
caatggttgaggctct

SEQ ID NO: 253 - DNA, 16 bp, Artificial sequence
  Synthetic oligonucletide
atttcaatggttgagg

SEQ ID NO: 254 - DNA, 16 bp, Artificial sequence
  Synthetic oligonucletide
aggcatttcaatggtt

SEQ ID NO: 255 - DNA, 16 bp, Artificial sequence
  Synthetic oligonucletide
tcacgatgatacagat

SEQ ID NO: 256 - DNA, 16 bp, Artificial sequence
  Synthetic oligonucletide
cagagaagcatcacga

SEQ ID NO: 257 - DNA, 16 bp, Artificial sequence
  Synthetic oligonucletide
gatctagaggttgtag

SEQ ID NO: 258 - DNA, 16 bp, Artificial sequence
  Synthetic oligonucletide
ttacaagatccaacag

SEQ ID NO: 259 - DNA, 16 bp, Artificial sequence
  Synthetic oligonucletide
gtgaacttgttggcag

SEQ ID NO: 260 - DNA, 16 bp, Artificial sequence
  Synthetic oligonucletide
attactttgatacttg

SEQ ID NO: 261 - DNA, 16 bp, Artificial sequence
  Synthetic oligonucletide
taagagtatggcctta

SEQ ID NO: 262 - DNA, 16 bp, Artificial sequence
  Synthetic oligonucletide
ttatgtaagagtatgg

SEQ ID NO: 263 - DNA, 16 bp, Artificial sequence
  Synthetic oligonucletide
attaaccaccagttct

SEQ ID NO: 264 - DNA, 16 bp, Artificial sequence
  Synthetic oligonucletide
cacatattaaccacca

SEQ ID NO: 265 - DNA, 16 bp, Artificial sequence
  Synthetic oligonucletide
gatatgactaatctca

SEQ ID NO: 266 - DNA, 16 bp, Artificial sequence
  Synthetic oligonucletide
tagtatattagtgata

SEQ ID NO: 267 - DNA, 16 bp, Artificial sequence
  Synthetic oligonucletide
tgaagattagattctg

SEQ ID NO: 268 - DNA, 16 bp, Artificial sequence
  Synthetic oligonucletide
aggtaactctagctca

SEQ ID NO: 269 - DNA, 16 bp, Artificial sequence
  Synthetic oligonucletide
gtatggtaagctaggt

SEQ ID NO: 270 - DNA, 16 bp, Artificial sequence
  Synthetic oligonucletide
agatatagtatggtaa

SEQ ID NO: 271 - DNA, 16 bp, Artificial sequence
  Synthetic oligonucletide
tctgaagtcttaaggt

SEQ ID NO: 272 - DNA, 16 bp, Artificial sequence
  Synthetic oligonucletide
ggccaacaagttcatt

SEQ ID NO: 273 - DNA, 16 bp, Artificial sequence
  Synthetic oligonucletide
atgtaatagatgggcc

SEQ ID NO: 274 - DNA, 16 bp, Artificial sequence
  Synthetic oligonucletide
cacgaattgtcagctc

SEQ ID NO: 275 - DNA, 16 bp, Artificial sequence
  Synthetic oligonucletide
tgcggacccacgaatt

SEQ ID NO: 276 - DNA, 16 bp, Artificial sequence
  Synthetic oligonucletide
ttaagattttgcggac

SEQ ID NO: 277 - DNA, 16 bp, Artificial sequence
  Synthetic oligonucletide
gctattaggtagttaa

SEQ ID NO: 278 - DNA, 16 bp, Artificial sequence
  Synthetic oligonucletide
aggtttatggtcaata

SEQ ID NO: 279 - DNA, 16 bp, Artificial sequence
  Synthetic oligonucletide
cacgcaaaatatgtgt

SEQ ID NO: 280 - DNA, 16 bp, Artificial sequence
  Synthetic oligonucletide
ttgtaggaatatagtg

SEQ ID NO: 281 - DNA, 16 bp, Artificial sequence
  Synthetic oligonucletide
cccctaagacaagact

SEQ ID NO: 282 - DNA, 16 bp, Artificial sequence
  Synthetic oligonucletide
cctattacagttgacc

SEQ ID NO: 283 - DNA, 16 bp, Artificial sequence
  Synthetic oligonucletide
catttggttgatagag

SEQ ID NO: 284 - DNA, 16 bp, Artificial sequence
  Synthetic oligonucletide
ctcagtagagtggact

SEQ ID NO: 285 - DNA, 16 bp, Artificial sequence
  Synthetic oligonucletide
atctataatttagctc

SEQ ID NO: 286 - DNA, 16 bp, Artificial sequence
  Synthetic oligonucletide
gtataggtgtaaacta

SEQ ID NO: 287 - DNA, 16 bp, Artificial sequence
  Synthetic oligonucletide
ttggattatgcagtat

SEQ ID NO: 288 - DNA, 16 bp, Artificial sequence
  Synthetic oligonucletide
acacatcctctactct

SEQ ID NO: 289 - DNA, 16 bp, Artificial sequence
  Synthetic oligonucletide
agtaaccatgttttag

SEQ ID NO: 290 - DNA, 16 bp, Artificial sequence
  Synthetic oligonucletide
gaaaccaaggtcaata

SEQ ID NO: 291 - DNA, 16 bp, Artificial sequence
  Synthetic oligonucletide
tgagttagcaacactt

SEQ ID NO: 292 - DNA, 16 bp, Artificial sequence
  Synthetic oligonucletide
cactattgagttagca

SEQ ID NO: 293 - DNA, 16 bp, Artificial sequence
  Synthetic oligonucletide
agatatccctgaacca

SEQ ID NO: 294 - DNA, 16 bp, Artificial sequence
  Synthetic oligonucletide
taagactagggatact

SEQ ID NO: 295 - DNA, 16 bp, Artificial sequence
  Synthetic oligonucletide
ccctgtaaattaagat

SEQ ID NO: 296 - DNA, 16 bp, Artificial sequence
  Synthetic oligonucletide
accagtaaccaggatc

SEQ ID NO: 297 - DNA, 16 bp, Artificial sequence
  Synthetic oligonucletide
atagggtagaattcaa

SEQ ID NO: 298 - DNA, 16 bp, Artificial sequence
  Synthetic oligonucletide
gatgaactagttggga

SEQ ID NO: 299 - DNA, 16 bp, Artificial sequence
  Synthetic oligonucletide
ataattaagaggacca

SEQ ID NO: 300 - DNA, 16 bp, Artificial sequence
  Synthetic oligonucletide
tagaataaagtatcga

SEQ ID NO: 301 - DNA, 16 bp, Artificial sequence
  Synthetic oligonucletide
tagtattgagaaagtc

SEQ ID NO: 302 - DNA, 16 bp, Artificial sequence
  Synthetic oligonucletide
agatttacgatgaatc

SEQ ID NO: 303 - DNA, 16 bp, Artificial sequence
  Synthetic oligonucletide
ctcaatagtcttctga

SEQ ID NO: 304 - DNA, 16 bp, Artificial sequence
  Synthetic oligonucletide
ctgtttaatagagtac

SEQ ID NO: 305 - DNA, 16 bp, Artificial sequence
  Synthetic oligonucletide
agtattaacctgaact

SEQ ID NO: 306 - DNA, 16 bp, Artificial sequence
  Synthetic oligonucletide
acagattaactagttc

SEQ ID NO: 307 - DNA, 16 bp, Artificial sequence
  Synthetic oligonucletide
atctatatgaggatat

SEQ ID NO: 308 - DNA, 16 bp, Artificial sequence
  Synthetic oligonucletide
gcatatacaggagtca

SEQ ID NO: 309 - DNA, 16 bp, Artificial sequence
  Synthetic oligonucletide
cttattgtagatctag

SEQ ID NO: 310 - DNA, 16 bp, Artificial sequence
  Synthetic oligonucletide
gtaagtatcaggcatg

SEQ ID NO: 311 - DNA, 16 bp, Artificial sequence
  Synthetic oligonucletide
acatattactacctta

SEQ ID NO: 312 - DNA, 16 bp, Artificial sequence
  Synthetic oligonucletide
cgttattaacacttgg

SEQ ID NO: 313 - DNA, 16 bp, Artificial sequence
  Synthetic oligonucletide
gagaatatgcaagccc

SEQ ID NO: 314 - DNA, 16 bp, Artificial sequence
  Synthetic oligonucletide
gtatttggtgaatcag

SEQ ID NO: 315 - DNA, 16 bp, Artificial sequence
  Synthetic oligonucletide
gtaacctatcctcaga

SEQ ID NO: 316 - DNA, 16 bp, Artificial sequence
  Synthetic oligonucletide
gagttagtcaaccttt

SEQ ID NO: 317 - DNA, 16 bp, Artificial sequence
  Synthetic oligonucletide
gaacagcagaatccta

SEQ ID NO: 318 - DNA, 16 bp, Artificial sequence
  Synthetic oligonucletide
agcgaaatctgtttct

SEQ ID NO: 319 - DNA, 16 bp, Artificial sequence
  Synthetic oligonucletide
ctagactgatagtttc

SEQ ID NO: 320 - DNA, 16 bp, Artificial sequence
  Synthetic oligonucletide
gtgttattactttgat

SEQ ID NO: 321 - DNA, 16 bp, Artificial sequence
  Synthetic oligonucletide
tagtagtttccatcat

SEQ ID NO: 322 - DNA, 16 bp, Artificial sequence
  Synthetic oligonucletide
gaacttgtatatggcc

SEQ ID NO: 323 - DNA, 16 bp, Artificial sequence
  Synthetic oligonucletide
atgtcttagaacagat

SEQ ID NO: 324 - DNA, 16 bp, Artificial sequence
  Synthetic oligonucletide
gtaactagactttagg

SEQ ID NO: 325 - DNA, 16 bp, Artificial sequence
  Synthetic oligonucletide
actaaacttggacatt

SEQ ID NO: 326 - DNA, 16 bp, Artificial sequence
  Synthetic oligonucletide
tcaacatattactacc

SEQ ID NO: 327 - DNA, 16 bp, Artificial sequence
  Synthetic oligonucletide
ctgaagactgtcaagc

SEQ ID NO: 328 - DNA, 16 bp, Artificial sequence
  Synthetic oligonucletide
gatacagatcagcaag

SEQ ID NO: 329 - DNA, 16 bp, Artificial sequence
  Synthetic oligonucletide
ggattttaggtatcag

SEQ ID NO: 330 - DNA, 16 bp, Artificial sequence
  Synthetic oligonucletide
tgtacaaagagactac

SEQ ID NO: 331 - DNA, 16 bp, Artificial sequence
  Synthetic oligonucletide
aatagggtagaattca

SEQ ID NO: 332 - DNA, 16 bp, Artificial sequence
  Synthetic oligonucletide
gttaaagctctgtctt

SEQ ID NO: 333 - DNA, 16 bp, Artificial sequence
  Synthetic oligonucletide
gtatatagaggatgtg

SEQ ID NO: 334 - DNA, 16 bp, Artificial sequence
  Synthetic oligonucletide
tcactacagtgcctta

SEQ ID NO: 335 - DNA, 16 bp, Artificial sequence
  Synthetic oligonucletide
taggctattaggtagt

SEQ ID NO: 336 - DNA, 16 bp, Artificial sequence
  Synthetic oligonucletide
aatttgtgagccatgt

SEQ ID NO: 337 - DNA, 16 bp, Artificial sequence
  Synthetic oligonucletide
ctacaagtattggagt

SEQ ID NO: 338 - DNA, 16 bp, Artificial sequence
  Synthetic oligonucletide
agtcttaaggtttcat

SEQ ID NO: 339 - DNA, 16 bp, Artificial sequence
  Synthetic oligonucletide
cgaattgtcagctccc

SEQ ID NO: 340 - DNA, 16 bp, Artificial sequence
  Synthetic oligonucletide
ggttattcttttgggt

SEQ ID NO: 341 - DNA, 16 bp, Artificial sequence
  Synthetic oligonucletide
gccataagtgaatgtg

SEQ ID NO: 342 - DNA, 16 bp, Artificial sequence
  Synthetic oligonucletide
gcaatgtaatatcaga

SEQ ID NO: 343 - DNA, 16 bp, Artificial sequence
  Synthetic oligonucletide
gagcattaatctccat

SEQ ID NO: 344 - DNA, 16 bp, Artificial sequence
  Synthetic oligonucletide
aatacttaacttgcac

SEQ ID NO: 345 - DNA, 16 bp, Artificial sequence
  Synthetic oligonucletide
ccagtaaccaggatca

SEQ ID NO: 346 - DNA, 16 bp, Artificial sequence
  Synthetic oligonucletide
ttaatagctccagagc

SEQ ID NO: 347 - DNA, 16 bp, Artificial sequence
  Synthetic oligonucletide
aataactaagggcatc

SEQ ID NO: 348 - DNA, 16 bp, Artificial sequence
  Synthetic oligonucletide
aacaattcaaatacgg

SEQ ID NO: 349 - DNA, 16 bp, Artificial sequence
  Synthetic oligonucletide
ctgcatgggatgacag

SEQ ID NO: 350 - DNA, 16 bp, Artificial sequence
  Synthetic oligonucletide
acaacttaaacatgcc

SEQ ID NO: 351 - DNA, 16 bp, Artificial sequence
  Synthetic oligonucletide
ttaagtggtcgagaga

SEQ ID NO: 352 - DNA, 16 bp, Artificial sequence
  Synthetic oligonucletide
ttaggtagcctggaat

SEQ ID NO: 353 - DNA, 16 bp, Artificial sequence
  Synthetic oligonucletide
ctaatgtcatatacca

SEQ ID NO: 354 - DNA, 16 bp, Artificial sequence
  Synthetic oligonucletide
tgataatgtgcatgtt

SEQ ID NO: 355 - DNA, 16 bp, Artificial sequence
  Synthetic oligonucletide
agattctgatagttac

SEQ ID NO: 356 - DNA, 16 bp, Artificial sequence
  Synthetic oligonucletide
aataatgctgtgggca

SEQ ID NO: 357 - DNA, 16 bp, Artificial sequence
  Synthetic oligonucletide
tacaacaagctcccca

SEQ ID NO: 358 - DNA, 16 bp, Artificial sequence
  Synthetic oligonucletide
tggtaacaataagttt

SEQ ID NO: 359 - DNA, 16 bp, Artificial sequence
  Synthetic oligonucletide
tagaaatgccagactc

SEQ ID NO: 360 - DNA, 16 bp, Artificial sequence
  Synthetic oligonucletide
tatgactaatctcact

SEQ ID NO: 361 - DNA, 16 bp, Artificial sequence
  Synthetic oligonucletide
tttccatacttgattc

SEQ ID NO: 362 - DNA, 16 bp, Artificial sequence
  Synthetic oligonucletide
atatagtagactgggc

SEQ ID NO: 363 - DNA, 16 bp, Artificial sequence
  Synthetic oligonucletide
ctgatatactctagga

SEQ ID NO: 364 - DNA, 16 bp, Artificial sequence
  Synthetic oligonucletide
taattaagaggaccaa

SEQ ID NO: 365 - DNA, 16 bp, Artificial sequence
  Synthetic oligonucletide
cagaagtatgtgtact

SEQ ID NO: 366 - DNA, 16 bp, Artificial sequence
  Synthetic oligonucletide
atatatgaagtgaact

SEQ ID NO: 367 - DNA, 16 bp, Artificial sequence
  Synthetic oligonucletide
gcagaatacagttaag

SEQ ID NO: 368 - DNA, 16 bp, Artificial sequence
  Synthetic oligonucletide
gttttatgagttattg

SEQ ID NO: 369 - DNA, 16 bp, Artificial sequence
  Synthetic oligonucletide
cagtataggtgtaaac

SEQ ID NO: 370 - DNA, 16 bp, Artificial sequence
  Synthetic oligonucletide
tctagaggttgtagca

SEQ ID NO: 371 - DNA, 16 bp, Artificial sequence
  Synthetic oligonucletide
cacaatgtatggtact

SEQ ID NO: 372 - DNA, 16 bp, Artificial sequence
  Synthetic oligonucletide
ggatctataatttagc

SEQ ID NO: 373 - DNA, 16 bp, Artificial sequence
  Synthetic oligonucletide
accatttggttgatag

SEQ ID NO: 374 - DNA, 16 bp, Artificial sequence
  Synthetic oligonucletide
aacataagacacctac

SEQ ID NO: 375 - DNA, 16 bp, Artificial sequence
  Synthetic oligonucletide
agttatttgtaactac

SEQ ID NO: 376 - DNA, 16 bp, Artificial sequence
  Synthetic oligonucletide
taagtatcaggcatga

SEQ ID NO: 377 - DNA, 16 bp, Artificial sequence
  Synthetic oligonucletide
ttaataggcagaaatc

SEQ ID NO: 378 - DNA, 16 bp, Artificial sequence
  Synthetic oligonucletide
atgtaaatagctcagt

SEQ ID NO: 379 - DNA, 16 bp, Artificial sequence
  Synthetic oligonucletide
cgtaaagacatacacc

SEQ ID NO: 380 - DNA, 16 bp, Artificial sequence
  Synthetic oligonucletide
cttaaccctgtaggag

SEQ ID NO: 381 - DNA, 16 bp, Artificial sequence
  Synthetic oligonucletide
ttagttattaaggtgg

SEQ ID NO: 382 - DNA, 16 bp, Artificial sequence
  Synthetic oligonucletide
gtaggaatatagtgta

SEQ ID NO: 383 - DNA, 16 bp, Artificial sequence
  Synthetic oligonucletide
tacatgtactagaatt

SEQ ID NO: 384 - DNA, 16 bp, Artificial sequence
  Synthetic oligonucletide
aattgcaagggtccac

SEQ ID NO: 385 - DNA, 16 bp, Artificial sequence
  Synthetic oligonucletide
attagatttacgatga

SEQ ID NO: 386 - DNA, 16 bp, Artificial sequence
  Synthetic oligonucletide
gccaacaagttcattt

SEQ ID NO: 387 - DNA, 16 bp, Artificial sequence
  Synthetic oligonucletide
acagagatatgcccta

SEQ ID NO: 388 - DNA, 16 bp, Artificial sequence
  Synthetic oligonucletide
attaggatacctcagt

SEQ ID NO: 389 - DNA, 16 bp, Artificial sequence
  Synthetic oligonucletide
tggtaagctaggtaac

SEQ ID NO: 390 - DNA, 16 bp, Artificial sequence
  Synthetic oligonucletide
gataagaacttattct

SEQ ID NO: 391 - DNA, 16 bp, Artificial sequence
  Synthetic oligonucletide
gtaaccatgttttaga

SEQ ID NO: 392 - DNA, 16 bp, Artificial sequence
  Synthetic oligonucletide
tgcattggatgttagg

SEQ ID NO: 393 - DNA, 16 bp, Artificial sequence
  Synthetic oligonucletide
gcgaaatctgtttctt

SEQ ID NO: 394 - DNA, 16 bp, Artificial sequence
  Synthetic oligonucletide
tgtcttagaacagatt

SEQ ID NO: 395 - DNA, 16 bp, Artificial sequence
  Synthetic oligonucletide
tacaagtattggagta

SEQ ID NO: 396 - DNA, 16 bp, Artificial sequence
  Synthetic oligonucletide
gataatgtgcatgttg

SEQ ID NO: 397 - DNA, 16 bp, Artificial sequence
  Synthetic oligonucletide
cctaacccccatgttc

SEQ ID NO: 398 - DNA, 16 bp, Artificial sequence
  Synthetic oligonucletide
taactagactttaggt

SEQ ID NO: 399 - DNA, 16 bp, Artificial sequence
  Synthetic oligonucletide
ataattagacttggta

SEQ ID NO: 400 - DNA, 16 bp, Artificial sequence
  Synthetic oligonucletide
ccataagtgaatgtgc

SEQ ID NO: 401 - DNA, 16 bp, Artificial sequence
  Synthetic oligonucletide
catgtactagaattct

SEQ ID NO: 402 - DNA, 16 bp, Artificial sequence
  Synthetic oligonucletide
aacttaaacatgccag

SEQ ID NO: 403 - DNA, 16 bp, Artificial sequence
  Synthetic oligonucletide
tttatgagttattgga

SEQ ID NO: 404 - DNA, 16 bp, Artificial sequence
  Synthetic oligonucletide
tatatagaggatgtgc

SEQ ID NO: 405 - DNA, 16 bp, Artificial sequence
  Synthetic oligonucletide
cactacagtgccttaa

SEQ ID NO: 406 - DNA, 16 bp, Artificial sequence
  Synthetic oligonucletide
atagtagactgggcat

SEQ ID NO: 407 - DNA, 16 bp, Artificial sequence
  Synthetic oligonucletide
gcttacagagttacaa

SEQ ID NO: 408 - DNA, 16 bp, Artificial sequence
  Synthetic oligonucletide
tagttattaaggtgga

SEQ ID NO: 409 - DNA, 16 bp, Artificial sequence
  Synthetic oligonucletide
acataagacacctaca

SEQ ID NO: 410 - DNA, 16 bp, Artificial sequence
  Synthetic oligonucletide
ggaggtagtattgaga

SEQ ID NO: 411 - DNA, 16 bp, Artificial sequence
  Synthetic oligonucletide
gttattactttgatac

SEQ ID NO: 412 - DNA, 16 bp, Artificial sequence
  Synthetic oligonucletide
tgatatactctaggat

SEQ ID NO: 413 - DNA, 16 bp, Artificial sequence
  Synthetic oligonucletide
aatgtaatatcagatg

SEQ ID NO: 414 - DNA, 16 bp, Artificial sequence
  Synthetic oligonucletide
aagtatcaggcatgac

SEQ ID NO: 415 - DNA, 16 bp, Artificial sequence
  Synthetic oligonucletide
ctaaacttggacattc

SEQ ID NO: 416 - DNA, 16 bp, Artificial sequence
  Synthetic oligonucletide
gaagtatgtgtacttt

SEQ ID NO: 417 - DNA, 16 bp, Artificial sequence
  Synthetic oligonucletide
gaggttgtagcagaac

SEQ ID NO: 418 - DNA, 16 bp, Artificial sequence
  Synthetic oligonucletide
ggtaagctaggtaact

SEQ ID NO: 419 - DNA, 16 bp, Artificial sequence
  Synthetic oligonucletide
ccccacacccctaaga

SEQ ID NO: 420 - DNA, 16 bp, Artificial sequence
  Synthetic oligonucletide
gattttaggtatcaga

SEQ ID NO: 421 - DNA, 16 bp, Artificial sequence
  Synthetic oligonucletide
ttagatttacgatgaa

SEQ ID NO: 422 - DNA, 16 bp, Artificial sequence
  Synthetic oligonucletide
acttaacttgcacctt

SEQ ID NO: 423 - DNA, 16 bp, Artificial sequence
  Synthetic oligonucletide
ctaaatccgagagagg

SEQ ID NO: 424 - DNA, 16 bp, Artificial sequence
  Synthetic oligonucletide
catgttgaggaaatca

SEQ ID NO: 425 - DNA, 16 bp, Artificial sequence
  Synthetic oligonucletide
aaatagctatatccta

SEQ ID NO: 426 - DNA, 16 bp, Artificial sequence
  Synthetic oligonucletide
aatacatataacacgc

SEQ ID NO: 427 - DNA, 16 bp, Artificial sequence
  Synthetic oligonucletide
tcatataccatgttag

SEQ ID NO: 428 - DNA, 16 bp, Artificial sequence
  Synthetic oligonucletide
tacagatcagcaagag

SEQ ID NO: 429 - DNA, 16 bp, Artificial sequence
  Synthetic oligonucletide
ataactaagggcatct

SEQ ID NO: 430 - DNA, 16 bp, Artificial sequence
  Synthetic oligonucletide
atatttgtgtacacga

SEQ ID NO: 431 - DNA, 16 bp, Artificial sequence
  Synthetic oligonucletide
cctaaacaaccatgga

SEQ ID NO: 432 - DNA, 16 bp, Artificial sequence
  Synthetic oligonucletide
tataggtgtaaactat

SEQ ID NO: 433 - DNA, 16 bp, Artificial sequence
  Synthetic oligonucletide
ccacagagtatcttat

SEQ ID NO: 434 - DNA, 16 bp, Artificial sequence
  Synthetic oligonucletide
gtttaaagcatagtta

SEQ ID NO: 435 - DNA, 16 bp, Artificial sequence
  Synthetic oligonucletide
tgactaatctcactgt

SEQ ID NO: 436 - DNA, 16 bp, Artificial sequence
  Synthetic oligonucletide
tagttaagaatattcg

SEQ ID NO: 437 - DNA, 16 bp, Artificial sequence
  Synthetic oligonucletide
gtaaagacatacaccc

SEQ ID NO: 438 - DNA, 16 bp, Artificial sequence
  Synthetic oligonucletide
caacatattactacct

SEQ ID NO: 439 - DNA, 16 bp, Artificial sequence
  Synthetic oligonucletide
attattatctcactac

SEQ ID NO: 440 - DNA, 16 bp, Artificial sequence
  Synthetic oligonucletide
tgggtaaaagttctaa

SEQ ID NO: 441 - DNA, 16 bp, Artificial sequence
  Synthetic oligonucletide
gcattaatctccatct

SEQ ID NO: 442 - DNA, 16 bp, Artificial sequence
  Synthetic oligonucletide
ccacaagctattgctg

SEQ ID NO: 443 - DNA, 16 bp, Artificial sequence
  Synthetic oligonucletide
atcctatttttggagt

SEQ ID NO: 444 - DNA, 16 bp, Artificial sequence
  Synthetic oligonucletide
cagtaaccaggatcaa

SEQ ID NO: 445 - DNA, 16 bp, Artificial sequence
  Synthetic oligonucletide
gagcgagtgaggtatt

SEQ ID NO: 446 - DNA, 16 bp, Artificial sequence
  Synthetic oligonucletide
ggacgaatgtttgagc

SEQ ID NO: 447 - DNA, 16 bp, Artificial sequence
  Synthetic oligonucletide
ctattaggtagttaag

SEQ ID NO: 448 - DNA, 16 bp, Artificial sequence
  Synthetic oligonucletide
atatgaagtgaacttg

SEQ ID NO: 449 - DNA, 16 bp, Artificial sequence
  Synthetic oligonucletide
taagtggtcgagagaa

SEQ ID NO: 450 - DNA, 16 bp, Artificial sequence
  Synthetic oligonucletide
ggtaacaataagtttt

SEQ ID NO: 451 - DNA, 16 bp, Artificial sequence
  Synthetic oligonucletide
gatctataatttagct

SEQ ID NO: 452 - DNA, 16 bp, Artificial sequence
  Synthetic oligonucletide
ctaaacttaaatctgc

SEQ ID NO: 453 - DNA, 16 bp, Artificial sequence
  Synthetic oligonucletide
aaagatggagtacctt

SEQ ID NO: 454 - DNA, 16 bp, Artificial sequence
  Synthetic oligonucletide
gtcttaaggtttcatg

SEQ ID NO: 455 - DNA, 16 bp, Artificial sequence
  Synthetic oligonucletide
ttatttagtatcctag

SEQ ID NO: 456 - DNA, 16 bp, Artificial sequence
  Synthetic oligonucletide
aggtagcctggaatgt

SEQ ID NO: 457 - DNA, 16 bp, Artificial sequence
  Synthetic oligonucletide
gattctgatagttact

SEQ ID NO: 458 - DNA, 16 bp, Artificial sequence
  Synthetic oligonucletide
gcatacaacaaattgt

SEQ ID NO: 459 - DNA, 16 bp, Artificial sequence
  Synthetic oligonucletide
caatgtatggtactac

SEQ ID NO: 460 - DNA, 16 bp, Artificial sequence
  Synthetic oligonucletide
tgacaatttagcttat

SEQ ID NO: 461 - DNA, 16 bp, Artificial sequence
  Synthetic oligonucletide
acaattcaaatacggt

SEQ ID NO: 462 - DNA, 16 bp, Artificial sequence
  Synthetic oligonucletide
gtacaaagagactact

SEQ ID NO: 463 - DNA, 16 bp, Artificial sequence
  Synthetic oligonucletide
gacagattttaagctg

SEQ ID NO: 464 - DNA, 16 bp, Artificial sequence
  Synthetic oligonucletide
ttccatacttgattct

SEQ ID NO: 465 - DNA, 16 bp, Artificial sequence
  Synthetic oligonucletide
acaacaagctccccat

SEQ ID NO: 466 - DNA, 16 bp, Artificial sequence
  Synthetic oligonucletide
tgtaaatagctcagtt

SEQ ID NO: 467 - DNA, 16 bp, Artificial sequence
  Synthetic oligonucletide
gttaattacacatcct

SEQ ID NO: 468 - DNA, 16 bp, Artificial sequence
  Synthetic oligonucletide
gaacttattctatagt

SEQ ID NO: 469 - DNA, 16 bp, Artificial sequence
  Synthetic oligonucletide
agcgagtgaggtattg

SEQ ID NO: 470 - DNA, 16 bp, Artificial sequence
  Synthetic oligonucletide
atattactaccttacc

SEQ ID NO: 471 - DNA, 16 bp, Artificial sequence
  Synthetic oligonucletide
ataatttatggcatgg

SEQ ID NO: 472 - DNA, 16 bp, Artificial sequence
  Synthetic oligonucletide
catataccatgttagg

SEQ ID NO: 473 - DNA, 16 bp, Artificial sequence
  Synthetic oligonucletide
atttaatttattgggc

SEQ ID NO: 474 - DNA, 16 bp, Artificial sequence
  Synthetic oligonucletide
tccatacttgattctc

SEQ ID NO: 475 - DNA, 16 bp, Artificial sequence
  Synthetic oligonucletide
gtaagctaggtaactc

SEQ ID NO: 476 - DNA, 16 bp, Artificial sequence
  Synthetic oligonucletide
tatgaagtgaacttgt

SEQ ID NO: 477 - DNA, 16 bp, Artificial sequence
  Synthetic oligonucletide
ctaacccccatgttca

SEQ ID NO: 478 - DNA, 16 bp, Artificial sequence
  Synthetic oligonucletide
cctatttgaacatatg

SEQ ID NO: 479 - DNA, 16 bp, Artificial sequence
  Synthetic oligonucletide
cttaacttgcacctta

SEQ ID NO: 480 - DNA, 16 bp, Artificial sequence
  Synthetic oligonucletide
tcttatttgtagtgag

SEQ ID NO: 481 - DNA, 16 bp, Artificial sequence
  Synthetic oligonucletide
agtaaccaggatcaaa

SEQ ID NO: 482 - DNA, 16 bp, Artificial sequence
  Synthetic oligonucletide
agcatagttaacatac

SEQ ID NO: 483 - DNA, 16 bp, Artificial sequence
  Synthetic oligonucletide
ttcaaatacggtggga

SEQ ID NO: 484 - DNA, 16 bp, Artificial sequence
  Synthetic oligonucletide
cattaatctccatcta

SEQ ID NO: 485 - DNA, 16 bp, Artificial sequence
  Synthetic oligonucletide
ataggtgtaaactatt

SEQ ID NO: 486 - DNA, 16 bp, Artificial sequence
  Synthetic oligonucletide
aagtattggagtaatc

SEQ ID NO: 487 - DNA, 16 bp, Artificial sequence
  Synthetic oligonucletide
cataagacacctacac

SEQ ID NO: 488 - DNA, 16 bp, Artificial sequence
  Synthetic oligonucletide
gactagttagaacccg

SEQ ID NO: 489 - DNA, 16 bp, Artificial sequence
  Synthetic oligonucletide
aatagctatatcctat

SEQ ID NO: 490 - DNA, 16 bp, Artificial sequence
  Synthetic oligonucletide
tacaacaaattgttcc

SEQ ID NO: 491 - DNA, 16 bp, Artificial sequence
  Synthetic oligonucletide
ttatgagttattggaa

SEQ ID NO: 492 - DNA, 16 bp, Artificial sequence
  Synthetic oligonucletide
gccttaaatgaagatt

SEQ ID NO: 493 - DNA, 16 bp, Artificial sequence
  Synthetic oligonucletide
tatttagtatcctagt

SEQ ID NO: 494 - DNA, 16 bp, Artificial sequence
  Synthetic oligonucletide
ttattatctcactacc

SEQ ID NO: 495 - DNA, 16 bp, Artificial sequence
  Synthetic oligonucletide
aagtggtcgagagaaa

SEQ ID NO: 496 - DNA, 16 bp, Artificial sequence
  Synthetic oligonucletide
agtcaaatgactattc

SEQ ID NO: 497 - DNA, 16 bp, Artificial sequence
  Synthetic oligonucletide
taaacttggacattct

SEQ ID NO: 498 - DNA, 16 bp, Artificial sequence
  Synthetic oligonucletide
gtatcttatgtctgtg

SEQ ID NO: 499 - DNA, 16 bp, Artificial sequence
  Synthetic oligonucletide
gatatactctaggatg

SEQ ID NO: 500 - DNA, 16 bp, Artificial sequence
  Synthetic oligonucletide
taactaagggcatctg

SEQ ID NO: 501 - DNA, 16 bp, Artificial sequence
  Synthetic oligonucletide
ttcaaaggcactagag

SEQ ID NO: 502 - DNA, 16 bp, Artificial sequence
  Synthetic oligonucletide
ttatcagtaaggttta

SEQ ID NO: 503 - DNA, 16 bp, Artificial sequence
  Synthetic oligonucletide
tttaggtatcagatga

SEQ ID NO: 504 - DNA, 16 bp, Artificial sequence
  Synthetic oligonucletide
ccacacccctaagaca

SEQ ID NO: 505 - DNA, 16 bp, Artificial sequence
  Synthetic oligonucletide
attctgatagttacta

SEQ ID NO: 506 - DNA, 16 bp, Artificial sequence
  Synthetic oligonucletide
tacaaagagactactt

SEQ ID NO: 507 - DNA, 16 bp, Artificial sequence
  Synthetic oligonucletide
aggtagtattgagaaa

SEQ ID NO: 508 - DNA, 16 bp, Artificial sequence
  Synthetic oligonucletide
gatcagcaagagacat

SEQ ID NO: 509 - DNA, 16 bp, Artificial sequence
  Synthetic oligonucletide
gatttacgatgaatct

SEQ ID NO: 510 - DNA, 16 bp, Artificial sequence
  Synthetic oligonucletide
atatagaggatgtgca

SEQ ID NO: 511 - DNA, 16 bp, Artificial sequence
  Synthetic oligonucletide
gggtaaaagttctaac

SEQ ID NO: 512 - DNA, 16 bp, Artificial sequence
  Synthetic oligonucletide
agttattaaggtggaa

SEQ ID NO: 513 - DNA, 16 bp, Artificial sequence
  Synthetic oligonucletide
aagacatacacccatg

SEQ ID NO: 514 - DNA, 16 bp, Artificial sequence
  Synthetic oligonucletide
gttgaggaaatcaaca

SEQ ID NO: 515 - DNA, 16 bp, Artificial sequence
  Synthetic oligonucletide
aatgtatggtactacc

SEQ ID NO: 516 - DNA, 16 bp, Artificial sequence
  Synthetic oligonucletide
gttaaaaataagggac

SEQ ID NO: 517 - DNA, 16 bp, Artificial sequence
  Synthetic oligonucletide
tagtagactgggcatt

SEQ ID NO: 518 - DNA, 16 bp, Artificial sequence
  Synthetic oligonucletide
gacaatttagcttatt

SEQ ID NO: 519 - DNA, 16 bp, Artificial sequence
  Synthetic oligonucletide
ggatgttaggctggaa

SEQ ID NO: 520 - DNA, 16 bp, Artificial sequence
  Synthetic oligonucletide
agtatagagtattgtg

SEQ ID NO: 521 - DNA, 16 bp, Artificial sequence
  Synthetic oligonucletide
cataagtgaatgtgca

SEQ ID NO: 522 - DNA, 16 bp, Artificial sequence
  Synthetic oligonucletide
ttattactttgatact

SEQ ID NO: 523 - DNA, 16 bp, Artificial sequence
  Synthetic oligonucletide
cagattttaagctgat

SEQ ID NO: 524 - DNA, 16 bp, Artificial sequence
  Synthetic oligonucletide
aggaaatggagtacca

SEQ ID NO: 525 - DNA, 16 bp, Artificial sequence
  Synthetic oligonucletide
ttagagtaatatgtga

SEQ ID NO: 526 - DNA, 16 bp, Artificial sequence
  Synthetic oligonucletide
ttaggtagttaagatt

SEQ ID NO: 527 - DNA, 16 bp, Artificial sequence
  Synthetic oligonucletide
aggttgtagcagaact

SEQ ID NO: 528 - DNA, 16 bp, Artificial sequence
  Synthetic oligonucletide
gtagcctggaatgtaa

SEQ ID NO: 529 - DNA, 16 bp, Artificial sequence
  Synthetic oligonucletide
gattaactagttctaa

SEQ ID NO: 530 - DNA, 16 bp, Artificial sequence
  Synthetic oligonucletide
aactagactttaggtt

SEQ ID NO: 531 - DNA, 16 bp, Artificial sequence
  Synthetic oligonucletide
cttaaacatgccagtg

SEQ ID NO: 532 - DNA, 16 bp, Artificial sequence
  Synthetic oligonucletide
tgtactagaattctgt

SEQ ID NO: 533 - DNA, 16 bp, Artificial sequence
  Synthetic oligonucletide
tcttaaggtttcatga

SEQ ID NO: 534 - DNA, 16 bp, Artificial sequence
  Synthetic oligonucletide
cctatactttgatgat

SEQ ID NO: 535 - DNA, 16 bp, Artificial sequence
  Synthetic oligonucletide
agttttagtcttaatc

SEQ ID NO: 536 - DNA, 16 bp, Artificial sequence
  Synthetic oligonucletide
ctataatttagctcag

SEQ ID NO: 537 - DNA, 16 bp, Artificial sequence
  Synthetic oligonucletide
gtcttagaacagattt

SEQ ID NO: 538 - DNA, 16 bp, Artificial sequence
  Synthetic oligonucletide
tacacgagtatattag

SEQ ID NO: 539 - DNA, 16 bp, Artificial sequence
  Synthetic oligonucletide
atgtaatatcagatgc

SEQ ID NO: 540 - DNA, 16 bp, Artificial sequence
  Synthetic oligonucletide
gtaaatagctcagttc

SEQ ID NO: 541 - DNA, 16 bp, Artificial sequence
  Synthetic oligonucletide
gactaatctcactgtc

SEQ ID NO: 542 - DNA, 16 bp, Artificial sequence
  Synthetic oligonucletide
acacaagagtggtatt

SEQ ID NO: 543 - DNA, 16 bp, Artificial sequence
  Synthetic oligonucletide
gtagaacatatttgag

SEQ ID NO: 544 - DNA, 16 bp, Artificial sequence
  Synthetic oligonucletide
ttaattacacatcctc

SEQ ID NO: 545 - DNA, 16 bp, Artificial sequence
  Synthetic oligonucletide
aaattattctctaacg

SEQ ID NO: 546 - DNA, 16 bp, Artificial sequence
  Synthetic oligonucletide
aaacttggacattcta

SEQ ID NO: 547 - DNA, 16 bp, Artificial sequence
  Synthetic oligonucletide
taatttatggcatggt

SEQ ID NO: 548 - DNA, 16 bp, Artificial sequence
  Synthetic oligonucletide
tattactaccttaccc

SEQ ID NO: 549 - DNA, 16 bp, Artificial sequence
  Synthetic oligonucletide
tatagaggatgtgcat

SEQ ID NO: 550 - DNA, 16 bp, Artificial sequence
  Synthetic oligonucletide
gacttttatgtactat

SEQ ID NO: 551 - DNA, 16 bp, Artificial sequence
  Synthetic oligonucletide
accttaaggtatagat

SEQ ID NO: 552 - DNA, 16 bp, Artificial sequence
  Synthetic oligonucletide
tatagagtattgtgtt

SEQ ID NO: 553 - DNA, 16 bp, Artificial sequence
  Synthetic oligonucletide
atcttatgtctgtgga

SEQ ID NO: 554 - DNA, 16 bp, Artificial sequence
  Synthetic oligonucletide
gttattaaggtggaat

SEQ ID NO: 555 - DNA, 16 bp, Artificial sequence
  Synthetic oligonucletide
tttagctcagtagagt

SEQ ID NO: 556 - DNA, 16 bp, Artificial sequence
  Synthetic oligonucletide
tactagaattctgtga

SEQ ID NO: 557 - DNA, 16 bp, Artificial sequence
  Synthetic oligonucletide
gattttaagctgatgt

SEQ ID NO: 558 - DNA, 16 bp, Artificial sequence
  Synthetic oligonucletide
cacacccctaagacaa

SEQ ID NO: 559 - DNA, 16 bp, Artificial sequence
  Synthetic oligonucletide
taagtatgttcacttc

SEQ ID NO: 560 - DNA, 16 bp, Artificial sequence
  Synthetic oligonucletide
aaatagctcagttctg

SEQ ID NO: 561 - DNA, 16 bp, Artificial sequence
  Synthetic oligonucletide
gtagtattgagaaagt

SEQ ID NO: 562 - DNA, 16 bp, Artificial sequence
  Synthetic oligonucletide
taaccaggatcaaaga

SEQ ID NO: 563 - DNA, 16 bp, Artificial sequence
  Synthetic oligonucletide
tactctaggatgtttt

SEQ ID NO: 564 - DNA, 16 bp, Artificial sequence
  Synthetic oligonucletide
ggaaatcaacagttgc

SEQ ID NO: 565 - DNA, 16 bp, Artificial sequence
  Synthetic oligonucletide
taacccccatgttcaa

SEQ ID NO: 566 - DNA, 16 bp, Artificial sequence
  Synthetic oligonucletide
ggaaatggagtaccac

SEQ ID NO: 567 - DNA, 16 bp, Artificial sequence
  Synthetic oligonucletide
gtcgagagaaagataa

SEQ ID NO: 568 - DNA, 16 bp, Artificial sequence
  Synthetic oligonucletide
gcatagttaacatact

SEQ ID NO: 569 - DNA, 16 bp, Artificial sequence
  Synthetic oligonucletide
cacaagagtggtattc

SEQ ID NO: 570 - DNA, 16 bp, Artificial sequence
  Synthetic oligonucletide
ataagggacatagcag

SEQ ID NO: 571 - DNA, 16 bp, Artificial sequence
  Synthetic oligonucletide
taagctaggtaactct

SEQ ID NO: 572 - DNA, 16 bp, Artificial sequence
  Synthetic oligonucletide
atgaagtgaacttgtt

SEQ ID NO: 573 - DNA, 16 bp, Artificial sequence
  Synthetic oligonucletide
gaagattagattctgt

SEQ ID NO: 574 - DNA, 16 bp, Artificial sequence
  Synthetic oligonucletide
acaatttagcttattg

SEQ ID NO: 575 - DNA, 16 bp, Artificial sequence
  Synthetic oligonucletide
atataccatgttaggc

SEQ ID NO: 576 - DNA, 16 bp, Artificial sequence
  Synthetic oligonucletide
tcaaatacggtgggat

SEQ ID NO: 577 - DNA, 16 bp, Artificial sequence
  Synthetic oligonucletide
aggtattggactttct

SEQ ID NO: 578 - DNA, 16 bp, Artificial sequence
  Synthetic oligonucletide
tattatctcactacca

SEQ ID NO: 579 - DNA, 16 bp, Artificial sequence
  Synthetic oligonucletide
tatgagttattggaag

SEQ ID NO: 580 - DNA, 16 bp, Artificial sequence
  Synthetic oligonucletide
tcagtaaggtttatgg

SEQ ID NO: 581 - DNA, 16 bp, Artificial sequence
  Synthetic oligonucletide
ctaatctcactgtcac

SEQ ID NO: 582 - DNA, 16 bp, Artificial sequence
  Synthetic oligonucletide
atcagcaagagacata

SEQ ID NO: 583 - DNA, 16 bp, Artificial sequence
  Synthetic oligonucletide
ctgttaactgagacat

SEQ ID NO: 584 - DNA, 16 bp, Artificial sequence
  Synthetic oligonucletide
aacatatggttttgtg

SEQ ID NO: 585 - DNA, 16 bp, Artificial sequence
  Synthetic oligonucletide
ttttttggacttgtgg

SEQ ID NO: 586 - DNA, 16 bp, Artificial sequence
  Synthetic oligonucletide
tagagtaatatgtgat

SEQ ID NO: 587 - DNA, 16 bp, Artificial sequence
  Synthetic oligonucletide
gatgttaggctggaat

SEQ ID NO: 588 - DNA, 16 bp, Artificial sequence
  Synthetic oligonucletide
gactttaggtttttta

SEQ ID NO: 589 - DNA, 16 bp, Artificial sequence
  Synthetic oligonucletide
tgtaatatcagatgca

SEQ ID NO: 590 - DNA, 16 bp, Artificial sequence
  Synthetic oligonucletide
catacttgattctcat

SEQ ID NO: 591 - DNA, 16 bp, Artificial sequence
  Synthetic oligonucletide
ttgtagcagaacttca

SEQ ID NO: 592 - DNA, 16 bp, Artificial sequence
  Synthetic oligonucletide
cataatattggtctgt

SEQ ID NO: 593 - DNA, 16 bp, Artificial sequence
  Synthetic oligonucletide
agacatacacccatga

SEQ ID NO: 594 - DNA, 16 bp, Artificial sequence
  Synthetic oligonucletide
taggtgtaaactattt

SEQ ID NO: 595 - DNA, 16 bp, Artificial sequence
  Synthetic oligonucletide
atagctatatcctatt

SEQ ID NO: 596 - DNA, 16 bp, Artificial sequence
  Synthetic oligonucletide
aatttattgggctcaa

SEQ ID NO: 597 - DNA, 16 bp, Artificial sequence
  Synthetic oligonucletide
agaacagatttatgat

SEQ ID NO: 598 - DNA, 16 bp, Artificial sequence
  Synthetic oligonucletide
cttatttgtagtgagc

SEQ ID NO: 599 - DNA, 16 bp, Artificial sequence
  Synthetic oligonucletide
atcagatgaattgaag

SEQ ID NO: 600 - DNA, 16 bp, Artificial sequence
  Synthetic oligonucletide
actagttagaacccgg

SEQ ID NO: 601 - DNA, 16 bp, Artificial sequence
  Synthetic oligonucletide
agtattggagtaatcc

SEQ ID NO: 602 - DNA, 16 bp, Artificial sequence
  Synthetic oligonucletide
atttacgatgaatctg

SEQ ID NO: 603 - DNA, 16 bp, Artificial sequence
  Synthetic oligonucletide
gtcaaatgactattca

SEQ ID NO: 604 - DNA, 16 bp, Artificial sequence
  Synthetic oligonucletide
acaaagagactacttg

SEQ ID NO: 605 - DNA, 16 bp, Artificial sequence
  Synthetic oligonucletide
ctagttctaataacaa

SEQ ID NO: 606 - DNA, 16 bp, Artificial sequence
  Synthetic oligonucletide
ttacatgtcattacag

SEQ ID NO: 607 - DNA, 16 bp, Artificial sequence
  Synthetic oligonucletide
tttagtcttaatcttg

SEQ ID NO: 608 - DNA, 16 bp, Artificial sequence
  Synthetic oligonucletide
aacctaatgtgcactg

SEQ ID NO: 609 - DNA, 16 bp, Artificial sequence
  Synthetic oligonucletide
acacgagtatattagg

SEQ ID NO: 610 - DNA, 16 bp, Artificial sequence
  Synthetic oligonucletide
acaacaaattgttccc

SEQ ID NO: 611 - DNA, 16 bp, Artificial sequence
  Synthetic oligonucletide
ctgatagttactacaa

SEQ ID NO: 612 - DNA, 16 bp, Artificial sequence
  Synthetic oligonucletide
ttactttgatacttgg

SEQ ID NO: 613 - DNA, 16 bp, Artificial sequence
  Synthetic oligonucletide
taggtagttaagattt

SEQ ID NO: 614 - DNA, 16 bp, Artificial sequence
  Synthetic oligonucletide
tcaaaggcactagagg

SEQ ID NO: 615 - DNA, 16 bp, Artificial sequence
  Synthetic oligonucletide
taaggtttcatgattc

SEQ ID NO: 616 - DNA, 16 bp, Artificial sequence
  Synthetic oligonucletide
aactaagggcatctgt

SEQ ID NO: 617 - DNA, 16 bp, Artificial sequence
  Synthetic oligonucletide
atcctagtacttagtg

SEQ ID NO: 618 - DNA, 16 bp, Artificial sequence
  Synthetic oligonucletide
gattagaatcatctat

SEQ ID NO: 619 - DNA, 16 bp, Artificial sequence
  Synthetic oligonucletide
ggtaaaagttctaaca

SEQ ID NO: 620 - DNA, 16 bp, Artificial sequence
  Synthetic oligonucletide
tgttaaaagttgactg

SEQ ID NO: 621 - DNA, 16 bp, Artificial sequence
  Synthetic oligonucletide
atattagtaacatgtc

SEQ ID NO: 622 - DNA, 16 bp, Artificial sequence
  Synthetic oligonucletide
agttatagtattctgt

SEQ ID NO: 623 - DNA, 16 bp, Artificial sequence
  Synthetic oligonucletide
tccataagttcctgga

SEQ ID NO: 624 - DNA, 16 bp, Artificial sequence
  Synthetic oligonucletide
catctaattggtttag

SEQ ID NO: 625 - DNA, 16 bp, Artificial sequence
  Synthetic oligonucletide
aacaatttgttagttg

SEQ ID NO: 626 - DNA, 16 bp, Artificial sequence
  Synthetic oligonucletide
gcactagaggtcctca

SEQ ID NO: 627 - DNA, 16 bp, Artificial sequence
  Synthetic oligonucletide
aatttatggcatggtt

SEQ ID NO: 628 - DNA, 16 bp, Artificial sequence
  Synthetic oligonucletide
gaagtgaacttgttgg

SEQ ID NO: 629 - DNA, 16 bp, Artificial sequence
  Synthetic oligonucletide
gctcagtagagtggac

SEQ ID NO: 630 - DNA, 16 bp, Artificial sequence
  Synthetic oligonucletide
atgttaggctggaatg

SEQ ID NO: 631 - DNA, 16 bp, Artificial sequence
  Synthetic oligonucletide
tcctagtacttagtgc

SEQ ID NO: 632 - DNA, 16 bp, Artificial sequence
  Synthetic oligonucletide
aaggtttcatgattcc

SEQ ID NO: 633 - DNA, 16 bp, Artificial sequence
  Synthetic oligonucletide
tagctatatcctatta

SEQ ID NO: 634 - DNA, 16 bp, Artificial sequence
  Synthetic oligonucletide
ttttaagctgatgtgg

SEQ ID NO: 635 - DNA, 16 bp, Artificial sequence
  Synthetic oligonucletide
acccccatgttcaagg

SEQ ID NO: 636 - DNA, 16 bp, Artificial sequence
  Synthetic oligonucletide
atagagtattgtgttg

SEQ ID NO: 637 - DNA, 16 bp, Artificial sequence
  Synthetic oligonucletide
acataatttagtgtac

SEQ ID NO: 638 - DNA, 16 bp, Artificial sequence
  Synthetic oligonucletide
cagtaaggtttatggt

SEQ ID NO: 639 - DNA, 16 bp, Artificial sequence
  Synthetic oligonucletide
gactattaagaatgta

SEQ ID NO: 640 - DNA, 16 bp, Artificial sequence
  Synthetic oligonucletide
ccaaatatgagataac

SEQ ID NO: 641 - DNA, 16 bp, Artificial sequence
  Synthetic oligonucletide
caagagtggtattcat

SEQ ID NO: 642 - DNA, 16 bp, Artificial sequence
  Synthetic oligonucletide
cagtatttttggtggt

SEQ ID NO: 643 - DNA, 16 bp, Artificial sequence
  Synthetic oligonucletide
agagtaatatgtgata

SEQ ID NO: 644 - DNA, 16 bp, Artificial sequence
  Synthetic oligonucletide
gaaatcaacagttgca

SEQ ID NO: 645 - DNA, 16 bp, Artificial sequence
  Synthetic oligonucletide
gaagttactttgtggt

SEQ ID NO: 646 - DNA, 16 bp, Artificial sequence
  Synthetic oligonucletide
agttattggaagatgt

SEQ ID NO: 647 - DNA, 16 bp, Artificial sequence
  Synthetic oligonucletide
atacttgattctcatc

SEQ ID NO: 648 - DNA, 16 bp, Artificial sequence
  Synthetic oligonucletide
gatcttataatcctac

SEQ ID NO: 649 - DNA, 16 bp, Artificial sequence
  Synthetic oligonucletide
gagcaatagaattaac

SEQ ID NO: 650 - DNA, 16 bp, Artificial sequence
  Synthetic oligonucletide
cacccatgaatattca

SEQ ID NO: 651 - DNA, 16 bp, Artificial sequence
  Synthetic oligonucletide
aactgtattaactgtc

SEQ ID NO: 652 - DNA, 16 bp, Artificial sequence
  Synthetic oligonucletide
ggtgtaaactatttta

SEQ ID NO: 653 - DNA, 16 bp, Artificial sequence
  Synthetic oligonucletide
taatctcactgtcaca

SEQ ID NO: 654 - DNA, 16 bp, Artificial sequence
  Synthetic oligonucletide
attaaggtggaattgg

SEQ ID NO: 655 - DNA, 16 bp, Artificial sequence
  Synthetic oligonucletide
tgatagttactacaaa

SEQ ID NO: 656 - DNA, 16 bp, Artificial sequence
  Synthetic oligonucletide
gtggtaataaattagg

SEQ ID NO: 657 - DNA, 16 bp, Artificial sequence
  Synthetic oligonucletide
tttatgatttacctac

SEQ ID NO: 658 - DNA, 16 bp, Artificial sequence
  Synthetic oligonucletide
cactaccacagacata

SEQ ID NO: 659 - DNA, 16 bp, Artificial sequence
  Synthetic oligonucletide
gttctaacatatagtt

SEQ ID NO: 660 - DNA, 16 bp, Artificial sequence
  Synthetic oligonucletide
tgttaactgagacata

SEQ ID NO: 661 - DNA, 16 bp, Artificial sequence
  Synthetic oligonucletide
gatgaattgaaggcat

SEQ ID NO: 662 - DNA, 16 bp, Artificial sequence
  Synthetic oligonucletide
attaaccactactacc

SEQ ID NO: 663 - DNA, 16 bp, Artificial sequence
  Synthetic oligonucletide
tcagcaagagacatat

SEQ ID NO: 664 - DNA, 16 bp, Artificial sequence
  Synthetic oligonucletide
agattagattctgttg

SEQ ID NO: 665 - DNA, 16 bp, Artificial sequence
  Synthetic oligonucletide
gaggataataacttga

SEQ ID NO: 666 - DNA, 16 bp, Artificial sequence
  Synthetic oligonucletide
catctatgtaacctat

SEQ ID NO: 667 - DNA, 16 bp, Artificial sequence
  Synthetic oligonucletide
tagtcttaatcttgac

SEQ ID NO: 668 - DNA, 16 bp, Artificial sequence
  Synthetic oligonucletide
caacaaattgttccct

SEQ ID NO: 669 - DNA, 16 bp, Artificial sequence
  Synthetic oligonucletide
ctgtagcaaggagttc

SEQ ID NO: 670 - DNA, 16 bp, Artificial sequence
  Synthetic oligonucletide
caatttagcttattgc

SEQ ID NO: 671 - DNA, 16 bp, Artificial sequence
  Synthetic oligonucletide
tacgatgaatctgttg

SEQ ID NO: 672 - DNA, 16 bp, Artificial sequence
  Synthetic oligonucletide
gcatttgtatgatcac

SEQ ID NO: 673 - DNA, 16 bp, Artificial sequence
  Synthetic oligonucletide
agtattgagaaagtct

SEQ ID NO: 674 - DNA, 16 bp, Artificial sequence
  Synthetic oligonucletide
tataccatgttaggca

SEQ ID NO: 675 - DNA, 16 bp, Artificial sequence
  Synthetic oligonucletide
cacgagtatattagga

SEQ ID NO: 676 - DNA, 16 bp, Artificial sequence
  Synthetic oligonucletide
ctagttagaacccggc

SEQ ID NO: 677 - DNA, 16 bp, Artificial sequence
  Synthetic oligonucletide
gcttaaacttgacata

SEQ ID NO: 678 - DNA, 16 bp, Artificial sequence
  Synthetic oligonucletide
cttaaggtatagatga

SEQ ID NO: 679 - DNA, 16 bp, Artificial sequence
  Synthetic oligonucletide
acctaatgtgcactgt

SEQ ID NO: 680 - DNA, 16 bp, Artificial sequence
  Synthetic oligonucletide
tactttgatacttggt

SEQ ID NO: 681 - DNA, 16 bp, Artificial sequence
  Synthetic oligonucletide
gtcttaaaaggtcaga

SEQ ID NO: 682 - DNA, 16 bp, Artificial sequence
  Synthetic oligonucletide
actagaattctgtgat

SEQ ID NO: 683 - DNA, 16 bp, Artificial sequence
  Synthetic oligonucletide
catgattactctactt

SEQ ID NO: 684 - DNA, 16 bp, Artificial sequence
  Synthetic oligonucletide
gatgaatatgaccttt

SEQ ID NO: 685 - DNA, 16 bp, Artificial sequence
  Synthetic oligonucletide
gactattcatattagt

SEQ ID NO: 686 - DNA, 16 bp, Artificial sequence
  Synthetic oligonucletide
aagctaggtaactcta

SEQ ID NO: 687 - DNA, 16 bp, Artificial sequence
  Synthetic oligonucletide
gatcttgagcagttca

SEQ ID NO: 688 - DNA, 16 bp, Artificial sequence
  Synthetic oligonucletide
gttaaaagttgactgg

SEQ ID NO: 689 - DNA, 16 bp, Artificial sequence
  Synthetic oligonucletide
ggtagttaagattttg

SEQ ID NO: 690 - DNA, 16 bp, Artificial sequence
  Synthetic oligonucletide
cttaccccaggtgtca

SEQ ID NO: 691 - DNA, 16 bp, Artificial sequence
  Synthetic oligonucletide
atgtactatcaaagga

SEQ ID NO: 692 - DNA, 16 bp, Artificial sequence
  Synthetic oligonucletide
taatatcagatgcatt

SEQ ID NO: 693 - DNA, 16 bp, Artificial sequence
  Synthetic oligonucletide
atttattgggctcaat

SEQ ID NO: 694 - DNA, 16 bp, Artificial sequence
  Synthetic oligonucletide
gactacttgattctag

SEQ ID NO: 695 - DNA, 16 bp, Artificial sequence
  Synthetic oligonucletide
gactttctccatgata

SEQ ID NO: 696 - DNA, 16 bp, Artificial sequence
  Synthetic oligonucletide
acacccctaagacaag

SEQ ID NO: 697 - DNA, 16 bp, Artificial sequence
  Synthetic oligonucletide
ttcagagaagcatcac

SEQ ID NO: 698 - DNA, 16 bp, Artificial sequence
  Synthetic oligonucletide
tagtattctgtaatcc

SEQ ID NO: 699 - DNA, 16 bp, Artificial sequence
  Synthetic oligonucletide
tattagtaacatgtct

SEQ ID NO: 700 - DNA, 16 bp, Artificial sequence
  Synthetic oligonucletide
atgtttacaagatcca

SEQ ID NO: 701 - DNA, 16 bp, Artificial sequence
  Synthetic oligonucletide
gattccaaagatatag

SEQ ID NO: 702 - DNA, 16 bp, Artificial sequence
  Synthetic oligonucletide
ttaaggtatagatgaa

SEQ ID NO: 703 - DNA, 16 bp, Artificial sequence
  Synthetic oligonucletide
tataatcctacaacag

SEQ ID NO: 704 - DNA, 16 bp, Artificial sequence
  Synthetic oligonucletide
taaggtttatggtcaa

SEQ ID NO: 705 - DNA, 16 bp, Artificial sequence
  Synthetic oligonucletide
tactattctttgtggg

SEQ ID NO: 706 - DNA, 16 bp, Artificial sequence
  Synthetic oligonucletide
atcctagttctactga

SEQ ID NO: 707 - DNA, 16 bp, Artificial sequence
  Synthetic oligonucletide
gcctaagattgaactg

SEQ ID NO: 708 - DNA, 16 bp, Artificial sequence
  Synthetic oligonucletide
ttaacatttgtcatag

SEQ ID NO: 709 - DNA, 16 bp, Artificial sequence
  Synthetic oligonucletide
cacccctaagacaaga

SEQ ID NO: 710 - DNA, 16 bp, Artificial sequence
  Synthetic oligonucletide
gctatatcctattaca

SEQ ID NO: 711 - DNA, 16 bp, Artificial sequence
  Synthetic oligonucletide
ttaaccactactacca

SEQ ID NO: 712 - DNA, 16 bp, Artificial sequence
  Synthetic oligonucletide
aaattgtagaataggg

SEQ ID NO: 713 - DNA, 16 bp, Artificial sequence
  Synthetic oligonucletide
tgtcacatattaacca

SEQ ID NO: 714 - DNA, 16 bp, Artificial sequence
  Synthetic oligonucletide
gatagttactacaaat

SEQ ID NO: 715 - DNA, 16 bp, Artificial sequence
  Synthetic oligonucletide
aaaatagatgcttacc

SEQ ID NO: 716 - DNA, 16 bp, Artificial sequence
  Synthetic oligonucletide
taaaagttgactggac

SEQ ID NO: 717 - DNA, 16 bp, Artificial sequence
  Synthetic oligonucletide
aattgttggattatgc

SEQ ID NO: 718 - DNA, 16 bp, Artificial sequence
  Synthetic oligonucletide
gaagcatatacaggag

SEQ ID NO: 719 - DNA, 16 bp, Artificial sequence
  Synthetic oligonucletide
tacttgattctcatca

SEQ ID NO: 720 - DNA, 16 bp, Artificial sequence
  Synthetic oligonucletide
ccacagacatatccta

SEQ ID NO: 721 - DNA, 16 bp, Artificial sequence
  Synthetic oligonucletide
tgagtatagagatatg

SEQ ID NO: 722 - DNA, 16 bp, Artificial sequence
  Synthetic oligonucletide
atctatgtaacctatc

SEQ ID NO: 723 - DNA, 16 bp, Artificial sequence
  Synthetic oligonucletide
ctagtacttagtgcat

SEQ ID NO: 724 - DNA, 16 bp, Artificial sequence
  Synthetic oligonucletide
taggtaactctagctc

SEQ ID NO: 725 - DNA, 16 bp, Artificial sequence
  Synthetic oligonucletide
caaattgtcttctagg

SEQ ID NO: 726 - DNA, 16 bp, Artificial sequence
  Synthetic oligonucletide
gactttacgcaaaaca

SEQ ID NO: 727 - DNA, 16 bp, Artificial sequence
  Synthetic oligonucletide
gcaaagacatgaaccg

SEQ ID NO: 728 - DNA, 16 bp, Artificial sequence
  Synthetic oligonucletide
actttgatacttggtg

SEQ ID NO: 729 - DNA, 16 bp, Artificial sequence
  Synthetic oligonucletide
gtgtaatgagtacatt

SEQ ID NO: 730 - DNA, 16 bp, Artificial sequence
  Synthetic oligonucletide
aatttagcttattgct

SEQ ID NO: 731 - DNA, 16 bp, Artificial sequence
  Synthetic oligonucletide
ctgtagatgtaattgg

SEQ ID NO: 732 - DNA, 16 bp, Artificial sequence
  Synthetic oligonucletide
gaatgtaatgctatgc

SEQ ID NO: 733 - DNA, 16 bp, Artificial sequence
  Synthetic oligonucletide
gtaaactattttagac

SEQ ID NO: 734 - DNA, 16 bp, Artificial sequence
  Synthetic oligonucletide
acaatttgttagttgg

SEQ ID NO: 735 - DNA, 16 bp, Artificial sequence
  Synthetic oligonucletide
gtccttttatacatcc

SEQ ID NO: 736 - DNA, 16 bp, Artificial sequence
  Synthetic oligonucletide
ggaatggaagacaacc

SEQ ID NO: 737 - DNA, 16 bp, Artificial sequence
  Synthetic oligonucletide
acgagtatattaggaa

SEQ ID NO: 738 - DNA, 16 bp, Artificial sequence
  Synthetic oligonucletide
catgttaggcaacatg

SEQ ID NO: 739 - DNA, 16 bp, Artificial sequence
  Synthetic oligonucletide
atttatggcatggttg

SEQ ID NO: 740 - DNA, 16 bp, Artificial sequence
  Synthetic oligonucletide
aggataataacttgac

SEQ ID NO: 741 - DNA, 16 bp, Artificial sequence
  Synthetic oligonucletide
atgatttacctacatg

SEQ ID NO: 742 - DNA, 16 bp, Artificial sequence
  Synthetic oligonucletide
atttttggtggtattc

SEQ ID NO: 743 - DNA, 16 bp, Artificial sequence
  Synthetic oligonucletide
actgtattaactgtcc

SEQ ID NO: 744 - DNA, 16 bp, Artificial sequence
  Synthetic oligonucletide
atctaattggtttaga

SEQ ID NO: 745 - DNA, 16 bp, Artificial sequence
  Synthetic oligonucletide
ctttaagttgcttatg

SEQ ID NO: 746 - DNA, 16 bp, Artificial sequence
  Synthetic oligonucletide
tcagagaagcatcacg

SEQ ID NO: 747 - DNA, 16 bp, Artificial sequence
  Synthetic oligonucletide
gagtaatatgtgatat

SEQ ID NO: 748 - DNA, 16 bp, Artificial sequence
  Synthetic oligonucletide
gtattgagaaagtctt

SEQ ID NO: 749 - DNA, 16 bp, Artificial sequence
  Synthetic oligonucletide
tttaagctgatgtggc

SEQ ID NO: 750 - DNA, 16 bp, Artificial sequence
  Synthetic oligonucletide
gcaagagacatattaa

SEQ ID NO: 751 - DNA, 16 bp, Artificial sequence
  Synthetic oligonucletide
ggtaataaattaggac

SEQ ID NO: 752 - DNA, 16 bp, Artificial sequence
  Synthetic oligonucletide
gtagttaagattttgc

SEQ ID NO: 753 - DNA, 16 bp, Artificial sequence
  Synthetic oligonucletide
ttaactgagacatact

SEQ ID NO: 754 - DNA, 16 bp, Artificial sequence
  Synthetic oligonucletide
cagctgtagatgtaat

SEQ ID NO: 755 - DNA, 16 bp, Artificial sequence
  Synthetic oligonucletide
accatatggtttatgg

SEQ ID NO: 756 - DNA, 16 bp, Artificial sequence
  Synthetic oligonucletide
gagtattgtgttgtat

SEQ ID NO: 757 - DNA, 16 bp, Artificial sequence
  Synthetic oligonucletide
atatgagataactgtc

SEQ ID NO: 758 - DNA, 16 bp, Artificial sequence
  Synthetic oligonucletide
gttgttagtatattag

SEQ ID NO: 759 - DNA, 16 bp, Artificial sequence
  Synthetic oligonucletide
atgaattgaaggcatg

SEQ ID NO: 760 - DNA, 16 bp, Artificial sequence
  Synthetic oligonucletide
ctagaataaagtatcg

SEQ ID NO: 761 - DNA, 16 bp, Artificial sequence
  Synthetic oligonucletide
tattatgtaagagtat

SEQ ID NO: 762 - DNA, 16 bp, Artificial sequence
  Synthetic oligonucletide
aagtgaacttgttggc

SEQ ID NO: 763 - DNA, 16 bp, Artificial sequence
  Synthetic oligonucletide
acaaattgttccctgg

SEQ ID NO: 764 - DNA, 16 bp, Artificial sequence
  Synthetic oligonucletide
gaatcttcaagctgct

SEQ ID NO: 765 - DNA, 16 bp, Artificial sequence
  Synthetic oligonucletide
gatgaatctgttggct

SEQ ID NO: 766 - DNA, 16 bp, Artificial sequence
  Synthetic oligonucletide
attggaagatgttctg

SEQ ID NO: 767 - DNA, 16 bp, Artificial sequence
  Synthetic oligonucletide
cttaatcttgaccttt

SEQ ID NO: 768 - DNA, 16 bp, Artificial sequence
  Synthetic oligonucletide
ctattcatattagttc

SEQ ID NO: 769 - DNA, 16 bp, Artificial sequence
  Synthetic oligonucletide
gaaaccagagtcccac

SEQ ID NO: 770 - DNA, 16 bp, Artificial sequence
  Synthetic oligonucletide
ctccatgataccagca

SEQ ID NO: 771 - DNA, 16 bp, Artificial sequence
  Synthetic oligonucletide
ttaaggtggaattggt

SEQ ID NO: 772 - DNA, 16 bp, Artificial sequence
  Synthetic oligonucletide
gcggaaggaacctcaa

SEQ ID NO: 773 - DNA, 16 bp, Artificial sequence
  Synthetic oligonucletide
taccaatttttattcg

SEQ ID NO: 774 - DNA, 16 bp, Artificial sequence
  Synthetic oligonucletide
cactagaggtcctcag

SEQ ID NO: 775 - DNA, 16 bp, Artificial sequence
  Synthetic oligonucletide
tagcaaggagttccaa

SEQ ID NO: 776 - DNA, 16 bp, Artificial sequence
  Synthetic oligonucletide
gtaacaaacagtgtaa

SEQ ID NO: 777 - DNA, 16 bp, Artificial sequence
  Synthetic oligonucletide
catatacaggagtcat

SEQ ID NO: 778 - DNA, 16 bp, Artificial sequence
  Synthetic oligonucletide
tcctaaattgacccat

SEQ ID NO: 779 - DNA, 16 bp, Artificial sequence
  Synthetic oligonucletide
tgaattgaaggcatga

SEQ ID NO: 780 - DNA, 16 bp, Artificial sequence
  Synthetic oligonucletide
cctaaattaatggtta

SEQ ID NO: 781 - DNA, 16 bp, Artificial sequence
  Synthetic oligonucletide
actgagacatactagt

SEQ ID NO: 782 - DNA, 16 bp, Artificial sequence
  Synthetic oligonucletide
aggtatagatgaacta

SEQ ID NO: 783 - DNA, 16 bp, Artificial sequence
  Synthetic oligonucletide
attgttggattatgca

SEQ ID NO: 784 - DNA, 16 bp, Artificial sequence
  Synthetic oligonucletide
aaggtttatggtcaat

SEQ ID NO: 785 - DNA, 16 bp, Artificial sequence
  Synthetic oligonucletide
atcctatttacagact

SEQ ID NO: 786 - DNA, 16 bp, Artificial sequence
  Synthetic oligonucletide
attgtagaatagggat

SEQ ID NO: 787 - DNA, 16 bp, Artificial sequence
  Synthetic oligonucletide
gtaactctagctcaga

SEQ ID NO: 788 - DNA, 16 bp, Artificial sequence
  Synthetic oligonucletide
gagaagcatcacgatg

SEQ ID NO: 789 - DNA, 16 bp, Artificial sequence
  Synthetic oligonucletide
caagagacatattaag

SEQ ID NO: 790 - DNA, 16 bp, Artificial sequence
  Synthetic oligonucletide
tgttaggcaacatgtt

SEQ ID NO: 791 - DNA, 16 bp, Artificial sequence
  Synthetic oligonucletide
accaatttttattcga

SEQ ID NO: 792 - DNA, 16 bp, Artificial sequence
  Synthetic oligonucletide
gaatcaagagtattga

SEQ ID NO: 793 - DNA, 16 bp, Artificial sequence
  Synthetic oligonucletide
ctatatcctattacag

SEQ ID NO: 794 - DNA, 16 bp, Artificial sequence
  Synthetic oligonucletide
tttgatacttggtgaa

SEQ ID NO: 795 - DNA, 16 bp, Artificial sequence
  Synthetic oligonucletide
tagttactacaaatag

SEQ ID NO: 796 - DNA, 16 bp, Artificial sequence
  Synthetic oligonucletide
actattgtatttatgc

SEQ ID NO: 797 - DNA, 16 bp, Artificial sequence
  Synthetic oligonucletide
cttgattctcatcaac

SEQ ID NO: 798 - DNA, 16 bp, Artificial sequence
  Synthetic oligonucletide
gtttagaagattagaa

SEQ ID NO: 799 - DNA, 16 bp, Artificial sequence
  Synthetic oligonucletide
tgtttacaagatccaa

SEQ ID NO: 800 - DNA, 16 bp, Artificial sequence
  Synthetic oligonucletide
atttagcttattgctg

SEQ ID NO: 801 - DNA, 16 bp, Artificial sequence
  Synthetic oligonucletide
tgatttacctacatgt

SEQ ID NO: 802 - DNA, 16 bp, Artificial sequence
  Synthetic oligonucletide
gtcacatattaaccac

SEQ ID NO: 803 - DNA, 16 bp, Artificial sequence
  Synthetic oligonucletide
tcaagaaaagtaacgc

SEQ ID NO: 804 - DNA, 16 bp, Artificial sequence
  Synthetic oligonucletide
ccatgataccagcagg

SEQ ID NO: 805 - DNA, 16 bp, Artificial sequence
  Synthetic oligonucletide
gactatgagtatgctg

SEQ ID NO: 806 - DNA, 16 bp, Artificial sequence
  Synthetic oligonucletide
tgtattaactgtccag

SEQ ID NO: 807 - DNA, 16 bp, Artificial sequence
  Synthetic oligonucletide
tttatggcatggttgt

SEQ ID NO: 808 - DNA, 16 bp, Artificial sequence
  Synthetic oligonucletide
gaaaacttttggtggc

SEQ ID NO: 809 - DNA, 16 bp, Artificial sequence
  Synthetic oligonucletide
ggataataacttgaca

SEQ ID NO: 810 - DNA, 16 bp, Artificial sequence
  Synthetic oligonucletide
ttaagctgatgtggca

SEQ ID NO: 811 - DNA, 16 bp, Artificial sequence
  Synthetic oligonucletide
tctgaaatggtcagag

SEQ ID NO: 812 - DNA, 16 bp, Artificial sequence
  Synthetic oligonucletide
ttccaaagatatagta

SEQ ID NO: 813 - DNA, 16 bp, Artificial sequence
  Synthetic oligonucletide
agaaactcttctactc

SEQ ID NO: 814 - DNA, 16 bp, Artificial sequence
  Synthetic oligonucletide
gtaataaattaggaca

SEQ ID NO: 815 - DNA, 16 bp, Artificial sequence
  Synthetic oligonucletide
agtgaacttgttggca

SEQ ID NO: 816 - DNA, 16 bp, Artificial sequence
  Synthetic oligonucletide
tattgagaaagtctta

SEQ ID NO: 817 - DNA, 16 bp, Artificial sequence
  Synthetic oligonucletide
tttaatagggctttag

SEQ ID NO: 818 - DNA, 16 bp, Artificial sequence
  Synthetic oligonucletide
gtgttgtatgaagtct

SEQ ID NO: 819 - DNA, 16 bp, Artificial sequence
  Synthetic oligonucletide
tagttaagattttgcg

SEQ ID NO: 820 - DNA, 16 bp, Artificial sequence
  Synthetic oligonucletide
tagtacttagtgcata

SEQ ID NO: 821 - DNA, 16 bp, Artificial sequence
  Synthetic oligonucletide
cactaattcatcttcc

SEQ ID NO: 822 - DNA, 16 bp, Artificial sequence
  Synthetic oligonucletide
gaatggaagacaacct

SEQ ID NO: 823 - DNA, 16 bp, Artificial sequence
  Synthetic oligonucletide
ccatatggtttatggt

SEQ ID NO: 824 - DNA, 16 bp, Artificial sequence
  Synthetic oligonucletide
caagtaatatctaagg

SEQ ID NO: 825 - DNA, 16 bp, Artificial sequence
  Synthetic oligonucletide
tggaaacaaattgggt

SEQ ID NO: 826 - DNA, 16 bp, Artificial sequence
  Synthetic oligonucletide
ggcttacaaaagttca

SEQ ID NO: 827 - DNA, 16 bp, Artificial sequence
  Synthetic oligonucletide
cgcaaaacaacatata

SEQ ID NO: 828 - DNA, 16 bp, Artificial sequence
  Synthetic oligonucletide
taacatttgtcatagg

SEQ ID NO: 829 - DNA, 16 bp, Artificial sequence
  Synthetic oligonucletide
caacatttgtatgatg

SEQ ID NO: 830 - DNA, 16 bp, Artificial sequence
  Synthetic oligonucletide
ctaagacaagactgca

SEQ ID NO: 831 - DNA, 16 bp, Artificial sequence
  Synthetic oligonucletide
attatgtaagagtatg

SEQ ID NO: 832 - DNA, 16 bp, Artificial sequence
  Synthetic oligonucletide
tcatattagttcagat

SEQ ID NO: 833 - DNA, 16 bp, Artificial sequence
  Synthetic oligonucletide
aaaagttgactggact

SEQ ID NO: 834 - DNA, 16 bp, Artificial sequence
  Synthetic oligonucletide
tccttttatacatccc

SEQ ID NO: 835 - DNA, 16 bp, Artificial sequence
  Synthetic oligonucletide
gtaatatgtgatatag

SEQ ID NO: 836 - DNA, 16 bp, Artificial sequence
  Synthetic oligonucletide
agctgtagatgtaata

SEQ ID NO: 837 - DNA, 16 bp, Artificial sequence
  Synthetic oligonucletide
tgttagtatattagtg

SEQ ID NO: 838 - DNA, 16 bp, Artificial sequence
  Synthetic oligonucletide
cctaagattgaactga

SEQ ID NO: 839 - DNA, 16 bp, Artificial sequence
  Synthetic oligonucletide
aactttagtcaactta

SEQ ID NO: 840 - DNA, 16 bp, Artificial sequence
  Synthetic oligonucletide
agaataaagtatcgaa

SEQ ID NO: 841 - DNA, 16 bp, Artificial sequence
  Synthetic oligonucletide
tatgagataactgtct

SEQ ID NO: 842 - DNA, 16 bp, Artificial sequence
  Synthetic oligonucletide
tctaaacaggtggcta

SEQ ID NO: 843 - DNA, 16 bp, Artificial sequence
  Synthetic oligonucletide
tagatgtaattggttt

SEQ ID NO: 844 - DNA, 16 bp, Artificial sequence
  Synthetic oligonucletide
ctactaccaaatatgg

SEQ ID NO: 845 - DNA, 16 bp, Artificial sequence
  Synthetic oligonucletide
gaatttaaatggagtg

SEQ ID NO: 846 - DNA, 16 bp, Artificial sequence
  Synthetic oligonucletide
taggaaattgctcttt

SEQ ID NO: 847 - DNA, 16 bp, Artificial sequence
  Synthetic oligonucletide
caaattgttccctgga

SEQ ID NO: 848 - DNA, 16 bp, Artificial sequence
  Synthetic oligonucletide
gagtatagagatatgg

SEQ ID NO: 849 - DNA, 16 bp, Artificial sequence
  Synthetic oligonucletide
aatagatgcttaccat

SEQ ID NO: 850 - DNA, 16 bp, Artificial sequence
  Synthetic oligonucletide
agaatatgcaagcccc

SEQ ID NO: 851 - DNA, 16 bp, Artificial sequence
  Synthetic oligonucletide
gcttattgtagatcta

SEQ ID NO: 852 - DNA, 16 bp, Artificial sequence
  Synthetic oligonucletide
aaagacatgaaccggc

SEQ ID NO: 853 - DNA, 16 bp, Artificial sequence
  Synthetic oligonucletide
ggaatatgactaatca

SEQ ID NO: 854 - DNA, 16 bp, Artificial sequence
  Synthetic oligonucletide
taggaaatgatagtgc

SEQ ID NO: 855 - DNA, 16 bp, Artificial sequence
  Synthetic oligonucletide
tggattatgcagtata

SEQ ID NO: 856 - DNA, 16 bp, Artificial sequence
  Synthetic oligonucletide
aaaacatgaaaggtgc

SEQ ID NO: 857 - DNA, 16 bp, Artificial sequence
  Synthetic oligonucletide
gctactatatatcaac

SEQ ID NO: 858 - DNA, 16 bp, Artificial sequence
  Synthetic oligonucletide
gaatatgcaagcccca

SEQ ID NO: 859 - DNA, 16 bp, Artificial sequence
  Synthetic oligonucletide
agtatagagatatgga

SEQ ID NO: 860 - DNA, 16 bp, Artificial sequence
  Synthetic oligonucletide
gtttatggtgtttaga

SEQ ID NO: 861 - DNA, 16 bp, Artificial sequence
  Synthetic oligonucletide
atgagataactgtctt

SEQ ID NO: 862 - DNA, 16 bp, Artificial sequence
  Synthetic oligonucletide
tggtaatatattgtct

SEQ ID NO: 863 - DNA, 16 bp, Artificial sequence
  Synthetic oligonucletide
gcagaaaactgttggg

SEQ ID NO: 864 - DNA, 16 bp, Artificial sequence
  Synthetic oligonucletide
gttgtatgaagtctta

SEQ ID NO: 865 - DNA, 16 bp, Artificial sequence
  Synthetic oligonucletide
cctatttacagacttc

SEQ ID NO: 866 - DNA, 16 bp, Artificial sequence
  Synthetic oligonucletide
ctgaaatggtcagagg

SEQ ID NO: 867 - DNA, 16 bp, Artificial sequence
  Synthetic oligonucletide
tagattgaataaacag

SEQ ID NO: 868 - DNA, 16 bp, Artificial sequence
  Synthetic oligonucletide
cttttatacatcccat

SEQ ID NO: 869 - DNA, 16 bp, Artificial sequence
  Synthetic oligonucletide
aatggaagacaacctg

SEQ ID NO: 870 - DNA, 16 bp, Artificial sequence
  Synthetic oligonucletide
agtacttagtgcataa

SEQ ID NO: 871 - DNA, 16 bp, Artificial sequence
  Synthetic oligonucletide
cctaaattgacccata

SEQ ID NO: 872 - DNA, 16 bp, Artificial sequence
  Synthetic oligonucletide
attaatggttacctga

SEQ ID NO: 873 - DNA, 16 bp, Artificial sequence
  Synthetic oligonucletide
aaagtatcgaaatgtg

SEQ ID NO: 874 - DNA, 16 bp, Artificial sequence
  Synthetic oligonucletide
aaagttgactggactt

SEQ ID NO: 875 - DNA, 16 bp, Artificial sequence
  Synthetic oligonucletide
gaaactcttctactca

SEQ ID NO: 876 - DNA, 16 bp, Artificial sequence
  Synthetic oligonucletide
gtatagatgaactagt

SEQ ID NO: 877 - DNA, 16 bp, Artificial sequence
  Synthetic oligonucletide
tatgatgataattagg

SEQ ID NO: 878 - DNA, 16 bp, Artificial sequence
  Synthetic oligonucletide
ttgtagaatagggatg

SEQ ID NO: 879 - DNA, 16 bp, Artificial sequence
  Synthetic oligonucletide
gaaacaaattgggtgt

SEQ ID NO: 880 - DNA, 16 bp, Artificial sequence
  Synthetic oligonucletide
ttcttaacagctaagc

SEQ ID NO: 881 - DNA, 16 bp, Artificial sequence
  Synthetic oligonucletide
ccaatttttattcgat

SEQ ID NO: 882 - DNA, 16 bp, Artificial sequence
  Synthetic oligonucletide
caagatggtattctgg

SEQ ID NO: 883 - DNA, 16 bp, Artificial sequence
  Synthetic oligonucletide
gcttattgctgttgct

SEQ ID NO: 884 - DNA, 16 bp, Artificial sequence
  Synthetic oligonucletide
ttaatagggctttagt

SEQ ID NO: 885 - DNA, 16 bp, Artificial sequence
  Synthetic oligonucletide
ttgagaaagtcttaag

SEQ ID NO: 886 - DNA, 16 bp, Artificial sequence
  Synthetic oligonucletide
tattaaccaccagttc

SEQ ID NO: 887 - DNA, 16 bp, Artificial sequence
  Synthetic oligonucletide
gtatattagtgatatg

SEQ ID NO: 888 - DNA, 16 bp, Artificial sequence
  Synthetic oligonucletide
tacaagatccaacaga

SEQ ID NO: 889 - DNA, 16 bp, Artificial sequence
  Synthetic oligonucletide
agacatactagtgagc

SEQ ID NO: 890 - DNA, 16 bp, Artificial sequence
  Synthetic oligonucletide
gagtatgctgtacatc

SEQ ID NO: 891 - DNA, 16 bp, Artificial sequence
  Synthetic oligonucletide
tatacaggagtcatcc

SEQ ID NO: 892 - DNA, 16 bp, Artificial sequence
  Synthetic oligonucletide
agatgttaatgtggca

SEQ ID NO: 893 - DNA, 16 bp, Artificial sequence
  Synthetic oligonucletide
gagtattttagcaatg

SEQ ID NO: 894 - DNA, 16 bp, Artificial sequence
  Synthetic oligonucletide
taagacaagactgcaa

SEQ ID NO: 895 - DNA, 16 bp, Artificial sequence
  Synthetic oligonucletide
ttgatacttggtgaag

SEQ ID NO: 896 - DNA, 16 bp, Artificial sequence
  Synthetic oligonucletide
taaattaggacagttc

SEQ ID NO: 897 - DNA, 16 bp, Artificial sequence
  Synthetic oligonucletide
catattagttcagatg

SEQ ID NO: 898 - DNA, 16 bp, Artificial sequence
  Synthetic oligonucletide
gaatttgccttttgcc

SEQ ID NO: 899 - DNA, 16 bp, Artificial sequence
  Synthetic oligonucletide
gagacatattaagatg

SEQ ID NO: 900 - DNA, 16 bp, Artificial sequence
  Synthetic oligonucletide
taagctgatgtggcaa

SEQ ID NO: 901 - DNA, 16 bp, Artificial sequence
  Synthetic oligonucletide
taactctagctcagat

SEQ ID NO: 902 - DNA, 16 bp, Artificial sequence
  Synthetic oligonucletide
tactaccaaatatggt

SEQ ID NO: 903 - DNA, 16 bp, Artificial sequence
  Synthetic oligonucletide
tgacaaaactataggc

SEQ ID NO: 904 - DNA, 16 bp, Artificial sequence
  Synthetic oligonucletide
ctaaacaggtggctaa

SEQ ID NO: 905 - DNA, 16 bp, Artificial sequence
  Synthetic oligonucletide
gatgtaattggtttga

SEQ ID NO: 906 - DNA, 16 bp, Artificial sequence
  Synthetic oligonucletide
aagtaatatctaaggc

SEQ ID NO: 907 - DNA, 16 bp, Artificial sequence
  Synthetic oligonucletide
tatatcctattacagt

SEQ ID NO: 908 - DNA, 16 bp, Artificial sequence
  Synthetic oligonucletide
atgataccagcaggac

SEQ ID NO: 909 - DNA, 16 bp, Artificial sequence
  Synthetic oligonucletide
gcttacaaaagttcac

SEQ ID NO: 910 - DNA, 16 bp, Artificial sequence
  Synthetic oligonucletide
ggtttatggtcaatag

SEQ ID NO: 911 - DNA, 16 bp, Artificial sequence
  Synthetic oligonucletide
agttactacaaatagt

SEQ ID NO: 912 - DNA, 16 bp, Artificial sequence
  Synthetic oligonucletide
gatttacctacatgta

SEQ ID NO: 913 - DNA, 16 bp, Artificial sequence
  Synthetic oligonucletide
aagattttgcggaccc

SEQ ID NO: 914 - DNA, 16 bp, Artificial sequence
  Synthetic oligonucletide
gcactattgttattta

SEQ ID NO: 915 - DNA, 16 bp, Artificial sequence
  Synthetic oligonucletide
gaacttgttggcagtg

SEQ ID NO: 916 - DNA, 16 bp, Artificial sequence
  Synthetic oligonucletide
agaagcatcacgatga

SEQ ID NO: 917 - DNA, 16 bp, Artificial sequence
  Synthetic oligonucletide
ctaagattgaactgat

SEQ ID NO: 918 - DNA, 16 bp, Artificial sequence
  Synthetic oligonucletide
atagatgcttaccatt

SEQ ID NO: 919 - DNA, 16 bp, Artificial sequence
  Synthetic oligonucletide
gtattaactgtccaga

SEQ ID NO: 920 - DNA, 16 bp, Artificial sequence
  Synthetic oligonucletide
tgtaagagtatggcct

SEQ ID NO: 921 - DNA, 16 bp, Artificial sequence
  Synthetic oligonucletide
ccaaagatatagtatg

SEQ ID NO: 922 - DNA, 16 bp, Artificial sequence
  Synthetic oligonucletide
gctttatgacttgcta

SEQ ID NO: 923 - DNA, 16 bp, Artificial sequence
  Synthetic oligonucletide
agtcaacttaaattac

SEQ ID NO: 924 - DNA, 16 bp, Artificial sequence
  Synthetic oligonucletide
tgtagatgtaatagat

SEQ ID NO: 925 - DNA, 16 bp, Artificial sequence
  Synthetic oligonucletide
acaataaaataactcg

SEQ ID NO: 926 - DNA, 16 bp, Artificial sequence
  Synthetic oligonucletide
ccatttttaccctagg

SEQ ID NO: 927 - DNA, 16 bp, Artificial sequence
  Synthetic oligonucletide
tgtcataggaattgag

SEQ ID NO: 928 - DNA, 16 bp, Artificial sequence
  Synthetic oligonucletide
tgttaaatgggaagtg

SEQ ID NO: 929 - DNA, 16 bp, Artificial sequence
  Synthetic oligonucletide
ttgtagatctagtgga

SEQ ID NO: 930 - DNA, 16 bp, Artificial sequence
  Synthetic oligonucletide
gaatatgactaatcag

SEQ ID NO: 931 - DNA, 16 bp, Artificial sequence
  Synthetic oligonucletide
atacttggtgaagacc

SEQ ID NO: 932 - DNA, 16 bp, Artificial sequence
  Synthetic oligonucletide
ttttatacatcccata

SEQ ID NO: 933 - DNA, 16 bp, Artificial sequence
  Synthetic oligonucletide
aaattaggacagttca

SEQ ID NO: 934 - DNA, 16 bp, Artificial sequence
  Synthetic oligonucletide
tttatggtcaatagta

SEQ ID NO: 935 - DNA, 16 bp, Artificial sequence
  Synthetic oligonucletide
gatgcttaccatttgg

SEQ ID NO: 936 - DNA, 16 bp, Artificial sequence
  Synthetic oligonucletide
cttacaaaagttcact

SEQ ID NO: 937 - DNA, 16 bp, Artificial sequence
  Synthetic oligonucletide
aatatgcaagccccac

SEQ ID NO: 938 - DNA, 16 bp, Artificial sequence
  Synthetic oligonucletide
actataggcattaata

SEQ ID NO: 939 - DNA, 16 bp, Artificial sequence
  Synthetic oligonucletide
gacaagactgcaagac

SEQ ID NO: 940 - DNA, 16 bp, Artificial sequence
  Synthetic oligonucletide
acaagatccaacagat

SEQ ID NO: 941 - DNA, 16 bp, Artificial sequence
  Synthetic oligonucletide
cttctactcaggaagt

SEQ ID NO: 942 - DNA, 16 bp, Artificial sequence
  Synthetic oligonucletide
caaagatatagtatgg

SEQ ID NO: 943 - DNA, 16 bp, Artificial sequence
  Synthetic oligonucletide
gtattaacctgaacta

SEQ ID NO: 944 - DNA, 16 bp, Artificial sequence
  Synthetic oligonucletide
atggaagacaacctgc

SEQ ID NO: 945 - DNA, 16 bp, Artificial sequence
  Synthetic oligonucletide
ttgtatgaagtcttac

SEQ ID NO: 946 - DNA, 16 bp, Artificial sequence
  Synthetic oligonucletide
gagtagtaactttagt

SEQ ID NO: 947 - DNA, 16 bp, Artificial sequence
  Synthetic oligonucletide
atggtaacataattgg

SEQ ID NO: 948 - DNA, 16 bp, Artificial sequence
  Synthetic oligonucletide
gatgttaatgtggcat

SEQ ID NO: 949 - DNA, 16 bp, Artificial sequence
  Synthetic oligonucletide
gtttagattctgtagt

SEQ ID NO: 950 - DNA, 16 bp, Artificial sequence
  Synthetic oligonucletide
gtcataggaattgaga

SEQ ID NO: 951 - DNA, 16 bp, Artificial sequence
  Synthetic oligonucletide
aaactttgattgattg

SEQ ID NO: 952 - DNA, 16 bp, Artificial sequence
  Synthetic oligonucletide
gtttatttggtaacac

SEQ ID NO: 953 - DNA, 16 bp, Artificial sequence
  Synthetic oligonucletide
gtgtaaaggagatgac

SEQ ID NO: 954 - DNA, 16 bp, Artificial sequence
  Synthetic oligonucletide
gttactacaaatagtt

SEQ ID NO: 955 - DNA, 16 bp, Artificial sequence
  Synthetic oligonucletide
gaagcatcacgatgat

SEQ ID NO: 956 - DNA, 16 bp, Artificial sequence
  Synthetic oligonucletide
ccttttgattgtctgc

SEQ ID NO: 957 - DNA, 16 bp, Artificial sequence
  Synthetic oligonucletide
aacttgttggcagtgc

SEQ ID NO: 958 - DNA, 16 bp, Artificial sequence
  Synthetic oligonucletide
gtgcataattggtatg

SEQ ID NO: 959 - DNA, 16 bp, Artificial sequence
  Synthetic oligonucletide
acccataatgaagtgc

SEQ ID NO: 960 - DNA, 16 bp, Artificial sequence
  Synthetic oligonucletide
gacatattaagatgag

SEQ ID NO: 961 - DNA, 16 bp, Artificial sequence
  Synthetic oligonucletide
tatagatgaactagtt

SEQ ID NO: 962 - DNA, 16 bp, Artificial sequence
  Synthetic oligonucletide
gatctagtggattgga

SEQ ID NO: 963 - DNA, 16 bp, Artificial sequence
  Synthetic oligonucletide
gttaaatgggaagtgt

SEQ ID NO: 964 - DNA, 16 bp, Artificial sequence
  Synthetic oligonucletide
tgtaattggtttgatc

SEQ ID NO: 965 - DNA, 16 bp, Artificial sequence
  Synthetic oligonucletide
attgaataaacaggac

SEQ ID NO: 966 - DNA, 16 bp, Artificial sequence
  Synthetic oligonucletide
tgagataactgtcttc

SEQ ID NO: 967 - DNA, 16 bp, Artificial sequence
  Synthetic oligonucletide
tagaaaagccattagg

SEQ ID NO: 968 - DNA, 16 bp, Artificial sequence
  Synthetic oligonucletide
cttaataacgggatga

SEQ ID NO: 969 - DNA, 16 bp, Artificial sequence
  Synthetic oligonucletide
gataatattggaatag

SEQ ID NO: 970 - DNA, 16 bp, Artificial sequence
  Synthetic oligonucletide
cttaataaatataccc

SEQ ID NO: 971 - DNA, 16 bp, Artificial sequence
  Synthetic oligonucletide
acccaatttgaagtgt

SEQ ID NO: 972 - DNA, 16 bp, Artificial sequence
  Synthetic oligonucletide
gtagatgtaatagatg

SEQ ID NO: 973 - DNA, 16 bp, Artificial sequence
  Synthetic oligonucletide
tgataattaggccaga

SEQ ID NO: 974 - DNA, 16 bp, Artificial sequence
  Synthetic oligonucletide
ctactatatatcaact

SEQ ID NO: 975 - DNA, 16 bp, Artificial sequence
  Synthetic oligonucletide
gtatagagatatggag

SEQ ID NO: 976 - DNA, 16 bp, Artificial sequence
  Synthetic oligonucletide
aagtatcgaaatgtga

SEQ ID NO: 977 - DNA, 16 bp, Artificial sequence
  Synthetic oligonucletide
gctttagtgttatcta

SEQ ID NO: 978 - DNA, 16 bp, Artificial sequence
  Synthetic oligonucletide
gttatttaggttgtct

SEQ ID NO: 979 - DNA, 16 bp, Artificial sequence
  Synthetic oligonucletide
gtagaatagggatgca

SEQ ID NO: 980 - DNA, 16 bp, Artificial sequence
  Synthetic oligonucletide
aatagcatagctggat

SEQ ID NO: 981 - DNA, 16 bp, Artificial sequence
  Synthetic oligonucletide
agattttgcggaccca

SEQ ID NO: 982 - DNA, 16 bp, Artificial sequence
  Synthetic oligonucletide
tatcctattacagttg

SEQ ID NO: 983 - DNA, 16 bp, Artificial sequence
  Synthetic oligonucletide
tcttaacagctaagct

SEQ ID NO: 984 - DNA, 16 bp, Artificial sequence
  Synthetic oligonucletide
tgctatattgtctgta

SEQ ID NO: 985 - DNA, 16 bp, Artificial sequence
  Synthetic oligonucletide
tgataccagcaggaca

SEQ ID NO: 986 - DNA, 16 bp, Artificial sequence
  Synthetic oligonucletide
acatactagtgagcta

SEQ ID NO: 987 - DNA, 16 bp, Artificial sequence
  Synthetic oligonucletide
atattagttcagatgt

SEQ ID NO: 988 - DNA, 16 bp, Artificial sequence
  Synthetic oligonucletide
ttactttaagccatgc

SEQ ID NO: 989 - DNA, 16 bp, Artificial sequence
  Synthetic oligonucletide
gattatgcagtatagg

SEQ ID NO: 990 - DNA, 16 bp, Artificial sequence
  Synthetic oligonucletide
ttaaccaccagttctc

SEQ ID NO: 991 - DNA, 16 bp, Artificial sequence
  Synthetic oligonucletide
tattaactgtccagag

SEQ ID NO: 992 - DNA, 16 bp, Artificial sequence
  Synthetic oligonucletide
ggtaatatattgtcta

SEQ ID NO: 993 - DNA, 16 bp, Artificial sequence
  Synthetic oligonucletide
aagagtatggccttac

SEQ ID NO: 994 - DNA, 16 bp, Artificial sequence
  Synthetic oligonucletide
ctacttaatagtagta

SEQ ID NO: 995 - DNA, 16 bp, Artificial sequence
  Synthetic oligonucletide
taagattgaactgata

SEQ ID NO: 996 - DNA, 16 bp, Artificial sequence
  Synthetic oligonucletide
aactctagctcagata

SEQ ID NO: 997 - DNA, 16 bp, Artificial sequence
  Synthetic oligonucletide
tatattagtgatatga

SEQ ID NO: 998 - DNA, 16 bp, Artificial sequence
  Synthetic oligonucletide
caatttttattcgata

SEQ ID NO: 999 - DNA, 16 bp, Artificial sequence
  Synthetic oligonucletide
aatatctaaggctaca

SEQ ID NO: 1000 - DNA, 16 bp, Artificial sequence
  Synthetic oligonucletide
atttacctacatgtac

SEQ ID NO: 1001 - DNA, 16 bp, Artificial sequence
  Synthetic oligonucletide
catgaaaggtgcttgt

SEQ ID NO: 1002 - DNA, 16 bp, Artificial sequence
  Synthetic oligonucletide
ggcaagctgcagatct

SEQ ID NO: 1003 - DNA, 16 bp, Artificial sequence
  Synthetic oligonucletide
gtcaacttaaattacc

SEQ ID NO: 1004 - DNA, 16 bp, Artificial sequence
  Synthetic oligonucletide
ctttatgacttgctag

SEQ ID NO: 1005 - DNA, 16 bp, Artificial sequence
  Synthetic oligonucletide
tctcaataaagacccc

SEQ ID NO: 1006 - DNA, 16 bp, Artificial sequence
  Synthetic oligonucletide
aaatgatagtgctgtc

SEQ ID NO: 1007 - DNA, 16 bp, Artificial sequence
  Synthetic oligonucletide
tgactaatcagttcaa

SEQ ID NO: 1008 - DNA, 16 bp, Artificial sequence
  Synthetic oligonucletide
catattaagatgagac

SEQ ID NO: 1009 - DNA, 16 bp, Artificial sequence
  Synthetic oligonucletide
atgcttaccatttggt

SEQ ID NO: 1010 - DNA, 16 bp, Artificial sequence
  Synthetic oligonucletide
tttatacatcccataa

SEQ ID NO: 1011 - DNA, 16 bp, Artificial sequence
  Synthetic oligonucletide
tggaagacaacctgca

SEQ ID NO: 1012 - DNA, 16 bp, Artificial sequence
  Synthetic oligonucletide
gattcttaaggttcag

SEQ ID NO: 1013 - DNA, 16 bp, Artificial sequence
  Synthetic oligonucletide
attatgcagtataggt

SEQ ID NO: 1014 - DNA, 16 bp, Artificial sequence
  Synthetic oligonucletide
agacaattgatacttt

SEQ ID NO: 1015 - DNA, 16 bp, Artificial sequence
  Synthetic oligonucletide
ttatggtcaatagtag

SEQ ID NO: 1016 - DNA, 16 bp, Artificial sequence
  Synthetic oligonucletide
taaccaccagttctca

SEQ ID NO: 1017 - DNA, 16 bp, Artificial sequence
  Synthetic oligonucletide
tagtgatatgactaat

SEQ ID NO: 1018 - DNA, 16 bp, Artificial sequence
  Synthetic oligonucletide
ttatctatatgaggat

SEQ ID NO: 1019 - DNA, 16 bp, Artificial sequence
  Synthetic oligonucletide
actgtattaatagctc

SEQ ID NO: 1020 - DNA, 16 bp, Artificial sequence
  Synthetic oligonucletide
caagctgcagatctag

SEQ ID NO: 1021 - DNA, 16 bp, Artificial sequence
  Synthetic oligonucletide
tactcaggaagtggtc

SEQ ID NO: 1022 - DNA, 16 bp, Artificial sequence
  Synthetic oligonucletide
aagaattaccaaagtc

SEQ ID NO: 1023 - DNA, 16 bp, Artificial sequence
  Synthetic oligonucletide
gagataactgtcttct

SEQ ID NO: 1024 - DNA, 16 bp, Artificial sequence
  Synthetic oligonucletide
cccataatgaagtgct

SEQ ID NO: 1025 - DNA, 16 bp, Artificial sequence
  Synthetic oligonucletide
atagatgaactagttg

SEQ ID NO: 1026 - DNA, 16 bp, Artificial sequence
  Synthetic oligonucletide
atagagatatggagac

SEQ ID NO: 1027 - DNA, 16 bp, Artificial sequence
  Synthetic oligonucletide
attaccaaagtttggt

SEQ ID NO: 1028 - DNA, 16 bp, Artificial sequence
  Synthetic oligonucletide
gactgcaagaccaacg

SEQ ID NO: 1029 - DNA, 16 bp, Artificial sequence
  Synthetic oligonucletide
atatctaaggctacag

SEQ ID NO: 1030 - DNA, 16 bp, Artificial sequence
  Synthetic oligonucletide
cccaatttgaagtgtg

SEQ ID NO: 1031 - DNA, 16 bp, Artificial sequence
  Synthetic oligonucletide
gatgttaagtactgaa

SEQ ID NO: 1032 - DNA, 16 bp, Artificial sequence
  Synthetic oligonucletide
gtaaaggagatgacca

SEQ ID NO: 1033 - DNA, 16 bp, Artificial sequence
  Synthetic oligonucletide
caagatccaacagatg

SEQ ID NO: 1034 - DNA, 16 bp, Artificial sequence
  Synthetic oligonucletide
gctatattgtctgtag

SEQ ID NO: 1035 - DNA, 16 bp, Artificial sequence
  Synthetic oligonucletide
tttacctacatgtact

SEQ ID NO: 1036 - DNA, 16 bp, Artificial sequence
  Synthetic oligonucletide
tactagtgagctaagg

SEQ ID NO: 1037 - DNA, 16 bp, Artificial sequence
  Synthetic oligonucletide
gtagtaactttagtcc

SEQ ID NO: 1038 - DNA, 16 bp, Artificial sequence
  Synthetic oligonucletide
tggtttaaggtacagc

SEQ ID NO: 1039 - DNA, 16 bp, Artificial sequence
  Synthetic oligonucletide
cttaacagctaagctg

SEQ ID NO: 1040 - DNA, 16 bp, Artificial sequence
  Synthetic oligonucletide
actctagctcagataa

SEQ ID NO: 1041 - DNA, 16 bp, Artificial sequence
  Synthetic oligonucletide
tgtatgaagtcttacg

SEQ ID NO: 1042 - DNA, 16 bp, Artificial sequence
  Synthetic oligonucletide
taatattggaataggc

SEQ ID NO: 1043 - DNA, 16 bp, Artificial sequence
  Synthetic oligonucletide
attaacctgaactagg

SEQ ID NO: 1044 - DNA, 16 bp, Artificial sequence
  Synthetic oligonucletide
tttagattctgtagtg

SEQ ID NO: 1045 - DNA, 16 bp, Artificial sequence
  Synthetic oligonucletide
tacttggtgaagacct

SEQ ID NO: 1046 - DNA, 16 bp, Artificial sequence
  Synthetic oligonucletide
gatatagtatggtaag

SEQ ID NO: 1047 - DNA, 16 bp, Artificial sequence
  Synthetic oligonucletide
aattaggacagttcat

SEQ ID NO: 1048 - DNA, 16 bp, Artificial sequence
  Synthetic oligonucletide
tactttaagccatgct

SEQ ID NO: 1049 - DNA, 16 bp, Artificial sequence
  Synthetic oligonucletide
accagataggccaggt

SEQ ID NO: 1050 - DNA, 16 bp, Artificial sequence
  Synthetic oligonucletide
actaaattgaggattg

SEQ ID NO: 1051 - DNA, 16 bp, Artificial sequence
  Synthetic oligonucletide
gtctaatttggagagg

SEQ ID NO: 1052 - DNA, 16 bp, Artificial sequence
  Synthetic oligonucletide
tgttaatgtggcatag

SEQ ID NO: 1053 - DNA, 16 bp, Artificial sequence
  Synthetic oligonucletide
gataattaggccagat

SEQ ID NO: 1054 - DNA, 16 bp, Artificial sequence
  Synthetic oligonucletide
atgaaaggtgcttgtt

SEQ ID NO: 1055 - DNA, 16 bp, Artificial sequence
  Synthetic oligonucletide
cttgttggcagtgcag

SEQ ID NO: 1056 - DNA, 16 bp, Artificial sequence
  Synthetic oligonucletide
tacttaatagtagtag

SEQ ID NO: 1057 - DNA, 16 bp, Artificial sequence
  Synthetic oligonucletide
agccattaggcaactc

SEQ ID NO: 1058 - DNA, 16 bp, Artificial sequence
  Synthetic oligonucletide
aatgatagtgctgtca

SEQ ID NO: 1059 - DNA, 16 bp, Artificial sequence
  Synthetic oligonucletide
tggtaacataattgga

SEQ ID NO: 1060 - DNA, 16 bp, Artificial sequence
  Synthetic oligonucletide
ataccagcaggacagg

SEQ ID NO: 1061 - DNA, 16 bp, Artificial sequence
  Synthetic oligonucletide
gaacaacaagggcttg

SEQ ID NO: 1062 - DNA, 16 bp, Artificial sequence
  Synthetic oligonucletide
ataaacaggacttgtc

SEQ ID NO: 1063 - DNA, 16 bp, Artificial sequence
  Synthetic oligonucletide
atacatacaacaagct

SEQ ID NO: 1064 - DNA, 16 bp, Artificial sequence
  Synthetic oligonucletide
tagcatagctggatct

SEQ ID NO: 1065 - DNA, 16 bp, Artificial sequence
  Synthetic oligonucletide
tacaaaagttcactcc

SEQ ID NO: 1066 - DNA, 16 bp, Artificial sequence
  Synthetic oligonucletide
gttattaacacttggg

SEQ ID NO: 1067 - DNA, 16 bp, Artificial sequence
  Synthetic oligonucletide
gcataattggtatgct

SEQ ID NO: 1068 - DNA, 16 bp, Artificial sequence
  Synthetic oligonucletide
atctagtggattggaa

SEQ ID NO: 1069 - DNA, 16 bp, Artificial sequence
  Synthetic oligonucletide
agagtatggccttact

SEQ ID NO: 1070 - DNA, 16 bp, Artificial sequence
  Synthetic oligonucletide
tggtaacacatgcttc

SEQ ID NO: 1071 - DNA, 16 bp, Artificial sequence
  Synthetic oligonucletide
catcacgatgatacag

SEQ ID NO: 1072 - DNA, 16 bp, Artificial sequence
  Synthetic oligonucletide
ataacagatgtgagga

SEQ ID NO: 1073 - DNA, 16 bp, Artificial sequence
  Synthetic oligonucletide
gtctataacacttcta

SEQ ID NO: 1074 - DNA, 16 bp, Artificial sequence
  Synthetic oligonucletide
tataggcattaatagg

SEQ ID NO: 1075 - DNA, 16 bp, Artificial sequence
  Synthetic oligonucletide
tattagttcagatgta

SEQ ID NO: 1076 - DNA, 16 bp, Artificial sequence
  Synthetic oligonucletide
atcgaaatgtgatttt

SEQ ID NO: 1077 - DNA, 16 bp, Artificial sequence
  Synthetic oligonucletide
tagatgtaatagatgg

SEQ ID NO: 1078 - DNA, 16 bp, Artificial sequence
  Synthetic oligonucletide
aactttgattgattgg

SEQ ID NO: 1079 - DNA, 16 bp, Artificial sequence
  Synthetic oligonucletide
tttattcgataataat

SEQ ID NO: 1080 - DNA, 16 bp, Artificial sequence
  Synthetic oligonucletide
actatatatcaactcc

SEQ ID NO: 1081 - DNA, 16 bp, Artificial sequence
  Synthetic oligonucletide
tagaatagggatgcag

SEQ ID NO: 1082 - DNA, 16 bp, Artificial sequence
  Synthetic oligonucletide
ttaataaatatacccc

SEQ ID NO: 1083 - DNA, 16 bp, Artificial sequence
  Synthetic oligonucletide
gcggacccacgaattg

SEQ ID NO: 1084 - DNA, 16 bp, Artificial sequence
  Synthetic oligonucletide
gtttttaagactaggg

SEQ ID NO: 1085 - DNA, 16 bp, Artificial sequence
  Synthetic oligonucletide
atgaactagttgggac

SEQ ID NO: 1086 - DNA, 16 bp, Artificial sequence
  Synthetic oligonucletide
tatctaaggctacagt

SEQ ID NO: 1087 - DNA, 16 bp, Artificial sequence
  Synthetic oligonucletide
gtctatatttggattg

SEQ ID NO: 1088 - DNA, 16 bp, Artificial sequence
  Synthetic oligonucletide
ccaatttgaagtgtga

SEQ ID NO: 1089 - DNA, 16 bp, Artificial sequence
  Synthetic oligonucletide
tcagtaattaactgcc

SEQ ID NO: 1090 - DNA, 16 bp, Artificial sequence
  Synthetic oligonucletide
ctgcagatctagaggt

SEQ ID NO: 1091 - DNA, 16 bp, Artificial sequence
  Synthetic oligonucletide
aataaatataccccct

SEQ ID NO: 1092 - DNA, 16 bp, Artificial sequence
  Synthetic oligonucletide
cggacccacgaattgt

SEQ ID NO: 1093 - DNA, 16 bp, Artificial sequence
  Synthetic oligonucletide
ttaacctgaactaggc

SEQ ID NO: 1094 - DNA, 16 bp, Artificial sequence
  Synthetic oligonucletide
ctaaattgaggattgt

SEQ ID NO: 1095 - DNA, 16 bp, Artificial sequence
  Synthetic oligonucletide
ttatgcagtataggtg

SEQ ID NO: 1096 - DNA, 16 bp, Artificial sequence
  Synthetic oligonucletide
cttaaggttcagttta

SEQ ID NO: 1097 - DNA, 16 bp, Artificial sequence
  Synthetic oligonucletide
attaggacagttcatc

SEQ ID NO: 1098 - DNA, 16 bp, Artificial sequence
  Synthetic oligonucletide
ttacctacatgtacta

SEQ ID NO: 1099 - DNA, 16 bp, Artificial sequence
  Synthetic oligonucletide
gacaaaccagtaacca

SEQ ID NO: 1100 - DNA, 16 bp, Artificial sequence
  Synthetic oligonucletide
gttcagatgtaaatag

SEQ ID NO: 1101 - DNA, 16 bp, Artificial sequence
  Synthetic oligonucletide
tacatacaacaagctc

SEQ ID NO: 1102 - DNA, 16 bp, Artificial sequence
  Synthetic oligonucletide
cataattggtatgctt

SEQ ID NO: 1103 - DNA, 16 bp, Artificial sequence
  Synthetic oligonucletide
tcagaattactctggg

SEQ ID NO: 1104 - DNA, 16 bp, Artificial sequence
  Synthetic oligonucletide
tcttttaggtagcctg

SEQ ID NO: 1105 - DNA, 16 bp, Artificial sequence
  Synthetic oligonucletide
ccataatgaagtgctt

SEQ ID NO: 1106 - DNA, 16 bp, Artificial sequence
  Synthetic oligonucletide
agatgtaatagatggg

SEQ ID NO: 1107 - DNA, 16 bp, Artificial sequence
  Synthetic oligonucletide
ttaacagctaagctgt

SEQ ID NO: 1108 - DNA, 16 bp, Artificial sequence
  Synthetic oligonucletide
taaaggagatgaccaa

SEQ ID NO: 1109 - DNA, 16 bp, Artificial sequence
  Synthetic oligonucletide
taaatagattctgtag

SEQ ID NO: 1110 - DNA, 16 bp, Artificial sequence
  Synthetic oligonucletide
gacttttatgttgacc

SEQ ID NO: 1111 - DNA, 16 bp, Artificial sequence
  Synthetic oligonucletide
ctgtattaatagctcc

SEQ ID NO: 1112 - DNA, 16 bp, Artificial sequence
  Synthetic oligonucletide
gggatagaaatttgtg

SEQ ID NO: 1113 - DNA, 16 bp, Artificial sequence
  Synthetic oligonucletide
acaaagataattaccc

SEQ ID NO: 1114 - DNA, 16 bp, Artificial sequence
  Synthetic oligonucletide
ctagctcagataattc

SEQ ID NO: 1115 - DNA, 16 bp, Artificial sequence
  Synthetic oligonucletide
cccataaaagcccatc

SEQ ID NO: 1116 - DNA, 16 bp, Artificial sequence
  Synthetic oligonucletide
cttaatagtagtagtt

SEQ ID NO: 1117 - DNA, 16 bp, Artificial sequence
  Synthetic oligonucletide
ataggcattaataggc

SEQ ID NO: 1118 - DNA, 16 bp, Artificial sequence
  Synthetic oligonucletide
tctataacacttctac

SEQ ID NO: 1119 - DNA, 16 bp, Artificial sequence
  Synthetic oligonucletide
gttaatgtggcataga

SEQ ID NO: 1120 - DNA, 16 bp, Artificial sequence
  Synthetic oligonucletide
ttatatttgagtagtc

SEQ ID NO: 1121 - DNA, 16 bp, Artificial sequence
  Synthetic oligonucletide
tcgataataatttgta

SEQ ID NO: 1122 - DNA, 16 bp, Artificial sequence
  Synthetic oligonucletide
gacaacctgcaaaatc

SEQ ID NO: 1123 - DNA, 16 bp, Artificial sequence
  Synthetic oligonucletide
agcatagctggatcta

SEQ ID NO: 1124 - DNA, 16 bp, Artificial sequence
  Synthetic oligonucletide
agtaaagcaagtactc

SEQ ID NO: 1125 - DNA, 16 bp, Artificial sequence
  Synthetic oligonucletide
gttaagtactgaagac

SEQ ID NO: 1126 - DNA, 16 bp, Artificial sequence
  Synthetic oligonucletide
gcttaccatttggttg

SEQ ID NO: 1127 - DNA, 16 bp, Artificial sequence
  Synthetic oligonucletide
cacgatgatacagatc

SEQ ID NO: 1128 - DNA, 16 bp, Artificial sequence
  Synthetic oligonucletide
ttagtattaaagaagc

SEQ ID NO: 1129 - DNA, 16 bp, Artificial sequence
  Synthetic oligonucletide
actttaagccatgctg

SEQ ID NO: 1130 - DNA, 16 bp, Artificial sequence
  Synthetic oligonucletide
ttggaataggcatgct

SEQ ID NO: 1131 - DNA, 16 bp, Artificial sequence
  Synthetic oligonucletide
ctatattgtctgtagg

SEQ ID NO: 1132 - DNA, 16 bp, Artificial sequence
  Synthetic oligonucletide
caaaagttcactccag

SEQ ID NO: 1133 - DNA, 16 bp, Artificial sequence
  Synthetic oligonucletide
gccattaggcaactct

SEQ ID NO: 1134 - DNA, 16 bp, Artificial sequence
  Synthetic oligonucletide
agtgatatgactaatc

SEQ ID NO: 1135 - DNA, 16 bp, Artificial sequence
  Synthetic oligonucletide
tctatatgaggatatc

SEQ ID NO: 1136 - DNA, 16 bp, Artificial sequence
  Synthetic oligonucletide
aacagatgtgaggagt

SEQ ID NO: 1137 - DNA, 16 bp, Artificial sequence
  Synthetic oligonucletide
gagctaagggtaagtt

SEQ ID NO: 1138 - DNA, 16 bp, Artificial sequence
  Synthetic oligonucletide
gaattatatagtagac

SEQ ID NO: 1139 - DNA, 16 bp, Artificial sequence
  Synthetic oligonucletide
ttaccaaagtttggtg

SEQ ID NO: 1140 - DNA, 16 bp, Artificial sequence
  Synthetic oligonucletide
atgaagtcttacgggt

SEQ ID NO: 1141 - DNA, 16 bp, Artificial sequence
  Synthetic oligonucletide
gaattaccaaagtcag

SEQ ID NO: 1142 - DNA, 16 bp, Artificial sequence
  Synthetic oligonucletide
tatggtcaatagtagg

SEQ ID NO: 1143 - DNA, 16 bp, Artificial sequence
  Synthetic oligonucletide
ctatatatcaactcct

SEQ ID NO: 1144 - DNA, 16 bp, Artificial sequence
  Synthetic oligonucletide
gacaattgatacttta

SEQ ID NO: 1145 - DNA, 16 bp, Artificial sequence
  Synthetic oligonucletide
agaatagggatgcagt

SEQ ID NO: 1146 - DNA, 16 bp, Artificial sequence
  Synthetic oligonucletide
atccatagaagatggg

SEQ ID NO: 1147 - DNA, 16 bp, Artificial sequence
  Synthetic oligonucletide
tagtatggtaagctag

SEQ ID NO: 1148 - DNA, 16 bp, Artificial sequence
  Synthetic oligonucletide
caccagttctcatctg

SEQ ID NO: 1149 - DNA, 16 bp, Artificial sequence
  Synthetic oligonucletide
tctaatttggagaggt

SEQ ID NO: 1150 - DNA, 16 bp, Artificial sequence
  Synthetic oligonucletide
cgaaatgtgatttttg

SEQ ID NO: 1151 - DNA, 16 bp, Artificial sequence
  Synthetic oligonucletide
tgcttaataactaagg

SEQ ID NO: 1152 - DNA, 16 bp, Artificial sequence
  Synthetic oligonucletide
acacaattaggatacc

SEQ ID NO: 1153 - DNA, 16 bp, Artificial sequence
  Synthetic oligonucletide
actcaggaagtggtct

SEQ ID NO: 1154 - DNA, 16 bp, Artificial sequence
  Synthetic oligonucletide
gtaactttagtccttg

SEQ ID NO: 1155 - DNA, 16 bp, Artificial sequence
  Synthetic oligonucletide
gatccaacagatgaat

SEQ ID NO: 1156 - DNA, 16 bp, Artificial sequence
  Synthetic oligonucletide
caacaagggcttgaat

SEQ ID NO: 1157 - DNA, 16 bp, Artificial sequence
  Synthetic oligonucletide
taccagcaggacagga

SEQ ID NO: 1158 - DNA, 16 bp, Artificial sequence
  Synthetic oligonucletide
ggtttaaggtacagct

SEQ ID NO: 1159 - DNA, 16 bp, Artificial sequence
  Synthetic oligonucletide
gagtatggccttactt

SEQ ID NO: 1160 - DNA, 16 bp, Artificial sequence
  Synthetic oligonucletide
cttgttaggagtttgg

SEQ ID NO: 1161 - DNA, 16 bp, Artificial sequence
  Synthetic oligonucletide
gactagggatactttc

SEQ ID NO: 1162 - DNA, 16 bp, Artificial sequence
  Synthetic oligonucletide
cataatgaagtgcttc

SEQ ID NO: 1163 - DNA, 16 bp, Artificial sequence
  Synthetic oligonucletide
agtattaaagaagctt

SEQ ID NO: 1164 - DNA, 16 bp, Artificial sequence
  Synthetic oligonucletide
ttctgaagtcttaagg

SEQ ID NO: 1165 - DNA, 16 bp, Artificial sequence
  Synthetic oligonucletide
gtttaaggtacagctt

SEQ ID NO: 1166 - DNA, 16 bp, Artificial sequence
  Synthetic oligonucletide
aatagtagtagtttcc

SEQ ID NO: 1167 - DNA, 16 bp, Artificial sequence
  Synthetic oligonucletide
aagataattacccagt

SEQ ID NO: 1168 - DNA, 16 bp, Artificial sequence
  Synthetic oligonucletide
tatgcagtataggtgt

SEQ ID NO: 1169 - DNA, 16 bp, Artificial sequence
  Synthetic oligonucletide
ataattggtatgcttc

SEQ ID NO: 1170 - DNA, 16 bp, Artificial sequence
  Synthetic oligonucletide
tggaataggcatgctg

SEQ ID NO: 1171 - DNA, 16 bp, Artificial sequence
  Synthetic oligonucletide
tacctacatgtactag

SEQ ID NO: 1172 - DNA, 16 bp, Artificial sequence
  Synthetic oligonucletide
catacattgagaattg

SEQ ID NO: 1173 - DNA, 16 bp, Artificial sequence
  Synthetic oligonucletide
catcattagatttacg

SEQ ID NO: 1174 - DNA, 16 bp, Artificial sequence
  Synthetic oligonucletide
ggacccacgaattgtc

SEQ ID NO: 1175 - DNA, 16 bp, Artificial sequence
  Synthetic oligonucletide
agtatggtaagctagg

SEQ ID NO: 1176 - DNA, 16 bp, Artificial sequence
  Synthetic oligonucletide
acatacaacaagctcc

SEQ ID NO: 1177 - DNA, 16 bp, Artificial sequence
  Synthetic oligonucletide
gcatagctggatctat

SEQ ID NO: 1178 - DNA, 16 bp, Artificial sequence
  Synthetic oligonucletide
gtgatatgactaatct

SEQ ID NO: 1179 - DNA, 16 bp, Artificial sequence
  Synthetic oligonucletide
actgataagccataag

SEQ ID NO: 1180 - DNA, 16 bp, Artificial sequence
  Synthetic oligonucletide
gtggactattttgaat

SEQ ID NO: 1181 - DNA, 16 bp, Artificial sequence
  Synthetic oligonucletide
gatgtaatagatgggc

SEQ ID NO: 1182 - DNA, 16 bp, Artificial sequence
  Synthetic oligonucletide
cttaccatttggttga

SEQ ID NO: 1183 - DNA, 16 bp, Artificial sequence
  Synthetic oligonucletide
gaaggtaagtatcagg

SEQ ID NO: 1184 - DNA, 16 bp, Artificial sequence
  Synthetic oligonucletide
taaattgaggattgta

SEQ ID NO: 1185 - DNA, 16 bp, Artificial sequence
  Synthetic oligonucletide
tatatttgagtagtca

SEQ ID NO: 1186 - DNA, 16 bp, Artificial sequence
  Synthetic oligonucletide
acttttatgttgaccc

SEQ ID NO: 1187 - DNA, 16 bp, Artificial sequence
  Synthetic oligonucletide
gatgttgtatatgctg

SEQ ID NO: 1188 - DNA, 16 bp, Artificial sequence
  Synthetic oligonucletide
attatatagtagactg

SEQ ID NO: 1189 - DNA, 16 bp, Artificial sequence
  Synthetic oligonucletide
tcctagtgaaaccttt

SEQ ID NO: 1190 - DNA, 16 bp, Artificial sequence
  Synthetic oligonucletide
agtatggccttacttt

SEQ ID NO: 1191 - DNA, 16 bp, Artificial sequence
  Synthetic oligonucletide
caaaccagtaaccagg

SEQ ID NO: 1192 - DNA, 16 bp, Artificial sequence
  Synthetic oligonucletide
cgatgatacagatcag

SEQ ID NO: 1193 - DNA, 16 bp, Artificial sequence
  Synthetic oligonucletide
ccattaggcaactcta

SEQ ID NO: 1194 - DNA, 16 bp, Artificial sequence
  Synthetic oligonucletide
caggaagtggtctgtt

SEQ ID NO: 1195 - DNA, 16 bp, Artificial sequence
  Synthetic oligonucletide
atagattctgtagctt

SEQ ID NO: 1196 - DNA, 16 bp, Artificial sequence
  Synthetic oligonucletide
taggcattaataggca

SEQ ID NO: 1197 - DNA, 16 bp, Artificial sequence
  Synthetic oligonucletide
gcttaataactaaggg

SEQ ID NO: 1198 - DNA, 16 bp, Artificial sequence
  Synthetic oligonucletide
taagtactgaagactg

SEQ ID NO: 1199 - DNA, 16 bp, Artificial sequence
  Synthetic oligonucletide
atatccagaggagtgt

SEQ ID NO: 1200 - DNA, 16 bp, Artificial sequence
  Synthetic oligonucletide
ctgaagttttaagtgg

SEQ ID NO: 1201 - DNA, 16 bp, Artificial sequence
  Synthetic oligonucletide
cttttaggtagcctgg

SEQ ID NO: 1202 - DNA, 16 bp, Artificial sequence
  Synthetic oligonucletide
ctaatttggagaggta

SEQ ID NO: 1203 - DNA, 16 bp, Artificial sequence
  Synthetic oligonucletide
acaagggcttgaattg

SEQ ID NO: 1204 - DNA, 16 bp, Artificial sequence
  Synthetic oligonucletide
gctaagggtaagttta

SEQ ID NO: 1205 - DNA, 16 bp, Artificial sequence
  Synthetic oligonucletide
gatcatatgtcttaga

SEQ ID NO: 1206 - DNA, 16 bp, Artificial sequence
  Synthetic oligonucletide
tgtgaaagttttgagg

SEQ ID NO: 1207 - DNA, 16 bp, Artificial sequence
  Synthetic oligonucletide
ggatagaaatttgtga

SEQ ID NO: 1208 - DNA, 16 bp, Artificial sequence
  Synthetic oligonucletide
ttcgatggaaagcata

SEQ ID NO: 1209 - DNA, 16 bp, Artificial sequence
  Synthetic oligonucletide
caatttgaagtgtgag

SEQ ID NO: 1210 - DNA, 16 bp, Artificial sequence
  Synthetic oligonucletide
tatattgtctgtaggt

SEQ ID NO: 1211 - DNA, 16 bp, Artificial sequence
  Synthetic oligonucletide
ataaatatacccccta

SEQ ID NO: 1212 - DNA, 16 bp, Artificial sequence
  Synthetic oligonucletide
gaactagttgggacac

SEQ ID NO: 1213 - DNA, 16 bp, Artificial sequence
  Synthetic oligonucletide
gaccaaaaatagtatc

SEQ ID NO: 1214 - DNA, 16 bp, Artificial sequence
  Synthetic oligonucletide
cagaattactctgggt

SEQ ID NO: 1215 - DNA, 16 bp, Artificial sequence
  Synthetic oligonucletide
tgcagatctagaggtt

SEQ ID NO: 1216 - DNA, 16 bp, Artificial sequence
  Synthetic oligonucletide
agataattcactacag

SEQ ID NO: 1217 - DNA, 16 bp, Artificial sequence
  Synthetic oligonucletide
ctatatgaggatatct

SEQ ID NO: 1218 - DNA, 16 bp, Artificial sequence
  Synthetic oligonucletide
ttactacaagtattgg

SEQ ID NO: 1219 - DNA, 16 bp, Artificial sequence
  Synthetic oligonucletide
gaatagggatgcagta

SEQ ID NO: 1220 - DNA, 16 bp, Artificial sequence
  Synthetic oligonucletide
acaattaggatacctc

SEQ ID NO: 1221 - DNA, 16 bp, Artificial sequence
  Synthetic oligonucletide
cgataataatttgtat

SEQ ID NO: 1222 - DNA, 16 bp, Artificial sequence
  Synthetic oligonucletide
cctaatactaaacttg

SEQ ID NO: 1223 - DNA, 16 bp, Artificial sequence
  Synthetic oligonucletide
atagtaggctattagg

SEQ ID NO: 1224 - DNA, 16 bp, Artificial sequence
  Synthetic oligonucletide
aattaccaaagtcagc

SEQ ID NO: 1225 - DNA, 16 bp, Artificial sequence
  Synthetic oligonucletide
tcagatgtaaatagct

SEQ ID NO: 1226 - DNA, 16 bp, Artificial sequence
  Synthetic oligonucletide
atatatcaactccttc

SEQ ID NO: 1227 - DNA, 16 bp, Artificial sequence
  Synthetic oligonucletide
atctaaggctacagtc

SEQ ID NO: 1228 - DNA, 16 bp, Artificial sequence
  Synthetic oligonucletide
aagtcttacgggtgtt

SEQ ID NO: 1229 - DNA, 16 bp, Artificial sequence
  Synthetic oligonucletide
gtaaagcaagtactct

SEQ ID NO: 1230 - DNA, 16 bp, Artificial sequence
  Synthetic oligonucletide
tgttaggagtttgggt

SEQ ID NO: 1231 - DNA, 16 bp, Artificial sequence
  Synthetic oligonucletide
ctttaagccatgctga

SEQ ID NO: 1232 - DNA, 16 bp, Artificial sequence
  Synthetic oligonucletide
tccaacagatgaatac

SEQ ID NO: 1233 - DNA, 16 bp, Artificial sequence
  Synthetic oligonucletide
taccaaagtttggtga

SEQ ID NO: 1234 - DNA, 16 bp, Artificial sequence
  Synthetic oligonucletide
atgtagattctgatag

SEQ ID NO: 1235 - DNA, 16 bp, Artificial sequence
  Synthetic oligonucletide
cagtaattaactgcca

SEQ ID NO: 1236 - DNA, 16 bp, Artificial sequence
  Synthetic oligonucletide
ctgaactaggctttgt

SEQ ID NO: 1237 - DNA, 16 bp, Artificial sequence
  Synthetic oligonucletide
tgtattaatagctcca

SEQ ID NO: 1238 - DNA, 16 bp, Artificial sequence
  Synthetic oligonucletide
aatttaatagtgtctc

SEQ ID NO: 1239 - DNA, 16 bp, Artificial sequence
  Synthetic oligonucletide
gaaaacctttgttgtg

SEQ ID NO: 1240 - DNA, 16 bp, Artificial sequence
  Synthetic oligonucletide
ctaatactaaacttgg

SEQ ID NO: 1241 - DNA, 16 bp, Artificial sequence
  Synthetic oligonucletide
aggaagtggtctgtta

SEQ ID NO: 1242 - DNA, 16 bp, Artificial sequence
  Synthetic oligonucletide
tatatgaggatatctg

SEQ ID NO: 1243 - DNA, 16 bp, Artificial sequence
  Synthetic oligonucletide
atagtagtagtttcca

SEQ ID NO: 1244 - DNA, 16 bp, Artificial sequence
  Synthetic oligonucletide
gactaatgtcatatac

SEQ ID NO: 1245 - DNA, 16 bp, Artificial sequence
  Synthetic oligonucletide
catgttaaagctctgt

SEQ ID NO: 1246 - DNA, 16 bp, Artificial sequence
  Synthetic oligonucletide
tcatatgtcttagaac

SEQ ID NO: 1247 - DNA, 16 bp, Artificial sequence
  Synthetic oligonucletide
ttatatagtagactgg

SEQ ID NO: 1248 - DNA, 16 bp, Artificial sequence
  Synthetic oligonucletide
gaggtaactagacttt

SEQ ID NO: 1249 - DNA, 16 bp, Artificial sequence
  Synthetic oligonucletide
aactagttgggacaca

SEQ ID NO: 1250 - DNA, 16 bp, Artificial sequence
  Synthetic oligonucletide
taccaaagtcagcgaa

SEQ ID NO: 1251 - DNA, 16 bp, Artificial sequence
  Synthetic oligonucletide
aaggtaagtatcaggc

SEQ ID NO: 1252 - DNA, 16 bp, Artificial sequence
  Synthetic oligonucletide
agtgagtaacagtggt

SEQ ID NO: 1253 - DNA, 16 bp, Artificial sequence
  Synthetic oligonucletide
atagaaatttgtgagc

SEQ ID NO: 1254 - DNA, 16 bp, Artificial sequence
  Synthetic oligonucletide
gtattaatagctccag

SEQ ID NO: 1255 - DNA, 16 bp, Artificial sequence
  Synthetic oligonucletide
ataattcactacagtg

SEQ ID NO: 1256 - DNA, 16 bp, Artificial sequence
  Synthetic oligonucletide
atgcagtataggtgta

SEQ ID NO: 1257 - DNA, 16 bp, Artificial sequence
  Synthetic oligonucletide
tctaatcataaatagt

SEQ ID NO: 1258 - DNA, 16 bp, Artificial sequence
  Synthetic oligonucletide
gtattaaagaagcttt

SEQ ID NO: 1259 - DNA, 16 bp, Artificial sequence
  Synthetic oligonucletide
ttttaggtagcctgga

SEQ ID NO: 1260 - DNA, 16 bp, Artificial sequence
  Synthetic oligonucletide
tgttttagcaatgtaa

SEQ ID NO: 1261 - DNA, 16 bp, Artificial sequence
  Synthetic oligonucletide
atcattagatttacga

SEQ ID NO: 1262 - DNA, 16 bp, Artificial sequence
  Synthetic oligonucletide
gatgaatacatatggt

SEQ ID NO: 1263 - DNA, 16 bp, Artificial sequence
  Synthetic oligonucletide
aaaccagtaaccagga

SEQ ID NO: 1264 - DNA, 16 bp, Artificial sequence
  Synthetic oligonucletide
ctgaagtcttaaggtt

SEQ ID NO: 1265 - DNA, 16 bp, Artificial sequence
  Synthetic oligonucletide
taattggtatgcttca

SEQ ID NO: 1266 - DNA, 16 bp, Artificial sequence
  Synthetic oligonucletide
tctaaggctacagtct

SEQ ID NO: 1267 - DNA, 16 bp, Artificial sequence
  Synthetic oligonucletide
gtaaatctttctgccg

SEQ ID NO: 1268 - DNA, 16 bp, Artificial sequence
  Synthetic oligonucletide
gaagttttaagtggtc

SEQ ID NO: 1269 - DNA, 16 bp, Artificial sequence
  Synthetic oligonucletide
tgtagattctgatagt

SEQ ID NO: 1270 - DNA, 16 bp, Artificial sequence
  Synthetic oligonucletide
agacatagtgactgtt

SEQ ID NO: 1271 - DNA, 16 bp, Artificial sequence
  Synthetic oligonucletide
tactacaagtattgga

SEQ ID NO: 1272 - DNA, 16 bp, Artificial sequence
  Synthetic oligonucletide
cctacatgtactagaa

SEQ ID NO: 1273 - DNA, 16 bp, Artificial sequence
  Synthetic oligonucletide
cagatctagaggttgt

SEQ ID NO: 1274 - DNA, 16 bp, Artificial sequence
  Synthetic oligonucletide
gataagccataagtga

SEQ ID NO: 1275 - DNA, 16 bp, Artificial sequence
  Synthetic oligonucletide
cagatgtaaatagctc

SEQ ID NO: 1276 - DNA, 16 bp, Artificial sequence
  Synthetic oligonucletide
tgatatgactaatctc

SEQ ID NO: 1277 - DNA, 16 bp, Artificial sequence
  Synthetic oligonucletide
taatagatgggccaac

SEQ ID NO: 1278 - DNA, 16 bp, Artificial sequence
  Synthetic oligonucletide
ttaccatttggttgat

SEQ ID NO: 1279 - DNA, 16 bp, Artificial sequence
  Synthetic oligonucletide
gacccacgaattgtca

SEQ ID NO: 1280 - DNA, 16 bp, Artificial sequence
  Synthetic oligonucletide
ccttacttttccatac

SEQ ID NO: 1281 - DNA, 16 bp, Artificial sequence
  Synthetic oligonucletide
gatacactcatgtaca

SEQ ID NO: 1282 - DNA, 16 bp, Artificial sequence
  Synthetic oligonucletide
ggcattaataggcaga

SEQ ID NO: 1283 - DNA, 16 bp, Artificial sequence
  Synthetic oligonucletide
caagtactctggctct

SEQ ID NO: 1284 - DNA, 16 bp, Artificial sequence
  Synthetic oligonucletide
cttgaattgcaagggt

SEQ ID NO: 1285 - DNA, 16 bp, Artificial sequence
  Synthetic oligonucletide
tttaagccatgctgat

SEQ ID NO: 1286 - DNA, 16 bp, Artificial sequence
  Synthetic oligonucletide
caattaggatacctca

SEQ ID NO: 1287 - DNA, 16 bp, Artificial sequence
  Synthetic oligonucletide
atatttgagtagtcac

SEQ ID NO: 1288 - DNA, 16 bp, Artificial sequence
  Synthetic oligonucletide
ctgtaggtttgccttc

SEQ ID NO: 1289 - DNA, 16 bp, Artificial sequence
  Synthetic oligonucletide
tttaaggtacagcttg

SEQ ID NO: 1290 - DNA, 16 bp, Artificial sequence
  Synthetic oligonucletide
accaaaaatagtatcc

SEQ ID NO: 1291 - DNA, 16 bp, Artificial sequence
  Synthetic oligonucletide
tgtatatgctgagcat

SEQ ID NO: 1292 - DNA, 16 bp, Artificial sequence
  Synthetic oligonucletide
aagtactgaagactgt

SEQ ID NO: 1293 - DNA, 16 bp, Artificial sequence
  Synthetic oligonucletide
ttttatgttgacccac

SEQ ID NO: 1294 - DNA, 16 bp, Artificial sequence
  Synthetic oligonucletide
gtgtagaaatgccaga

SEQ ID NO: 1295 - DNA, 16 bp, Artificial sequence
  Synthetic oligonucletide
gaattactctgggtaa

SEQ ID NO: 1296 - DNA, 16 bp, Artificial sequence
  Synthetic oligonucletide
gcagtatcaaatatat

SEQ ID NO: 1297 - DNA, 16 bp, Artificial sequence
  Synthetic oligonucletide
catacaacaagctccc

SEQ ID NO: 1298 - DNA, 16 bp, Artificial sequence
  Synthetic oligonucletide
ccctattaatgtgagt

SEQ ID NO: 1299 - DNA, 16 bp, Artificial sequence
  Synthetic oligonucletide
agttttgaggagatgt

SEQ ID NO: 1300 - DNA, 16 bp, Artificial sequence
  Synthetic oligonucletide
gaggattgtaacataa

SEQ ID NO: 1301 - DNA, 16 bp, Artificial sequence
  Synthetic oligonucletide
atgatacagatcagca

SEQ ID NO: 1302 - DNA, 16 bp, Artificial sequence
  Synthetic oligonucletide
accaaagtttggtgaa

SEQ ID NO: 1303 - DNA, 16 bp, Artificial sequence
  Synthetic oligonucletide
gaataggcatgctgat

SEQ ID NO: 1304 - DNA, 16 bp, Artificial sequence
  Synthetic oligonucletide
gaacagttgcagtagg

SEQ ID NO: 1305 - DNA, 16 bp, Artificial sequence
  Synthetic oligonucletide
aatacagagatatgcc

SEQ ID NO: 1306 - DNA, 16 bp, Artificial sequence
  Synthetic oligonucletide
cttaataactaagggc

SEQ ID NO: 1307 - DNA, 16 bp, Artificial sequence
  Synthetic oligonucletide
cttgttgaggcatttc

SEQ ID NO: 1308 - DNA, 16 bp, Artificial sequence
  Synthetic oligonucletide
gaaacctttcattagt

SEQ ID NO: 1309 - DNA, 16 bp, Artificial sequence
  Synthetic oligonucletide
tgacacttcatttgtg

SEQ ID NO: 1310 - DNA, 16 bp, Artificial sequence
  Synthetic oligonucletide
tatggtaagctaggta

SEQ ID NO: 1311 - DNA, 16 bp, Artificial sequence
  Synthetic oligonucletide
catagctggatctata

SEQ ID NO: 1312 - DNA, 16 bp, Artificial sequence
  Synthetic oligonucletide
ataacataagacacct

SEQ ID NO: 1313 - DNA, 16 bp, Artificial sequence
  Synthetic oligonucletide
tagtaggctattaggt

SEQ ID NO: 1314 - DNA, 16 bp, Artificial sequence
  Synthetic oligonucletide
atccagaagtatgtgt

SEQ ID NO: 1315 - DNA, 16 bp, Artificial sequence
  Synthetic oligonucletide
atttaatagtgtctcc

SEQ ID NO: 1316 - DNA, 16 bp, Artificial sequence
  Synthetic oligonucletide
gagttatagtattctg

SEQ ID NO: 1317 - DNA, 16 bp, Artificial sequence
  Synthetic oligonucletide
agcaatgtaatatcag

SEQ ID NO: 1318 - DNA, 16 bp, Artificial sequence
  Synthetic oligonucletide
atatgactaatctcac

SEQ ID NO: 1319 - DNA, 16 bp, Artificial sequence
  Synthetic oligonucletide
gtagattctgatagtt

SEQ ID NO: 1320 - DNA, 16 bp, Artificial sequence
  Synthetic oligonucletide
ctaatcataaatagtt

SEQ ID NO: 1321 - DNA, 16 bp, Artificial sequence
  Synthetic oligonucletide
tttaagtggtcgagag

SEQ ID NO: 1322 - DNA, 16 bp, Artificial sequence
  Synthetic oligonucletide
atagctggatctataa

SEQ ID NO: 1323 - DNA, 16 bp, Artificial sequence
  Synthetic oligonucletide
aatactaaacttggac

SEQ ID NO: 1324 - DNA, 16 bp, Artificial sequence
  Synthetic oligonucletide
gttgaggcatttcaat

SEQ ID NO: 1325 - DNA, 16 bp, Artificial sequence
  Synthetic oligonucletide
ttaataactaagggca

SEQ ID NO: 1326 - DNA, 16 bp, Artificial sequence
  Synthetic oligonucletide
actacaagtattggag

SEQ ID NO: 1327 - DNA, 16 bp, Artificial sequence
  Synthetic oligonucletide
agccataagtgaatgt

SEQ ID NO: 1328 - DNA, 16 bp, Artificial sequence
  Synthetic oligonucletide
tatatagtagactggg

SEQ ID NO: 1329 - DNA, 16 bp, Artificial sequence
  Synthetic oligonucletide
acacaatgtatggtac

SEQ ID NO: 1330 - DNA, 16 bp, Artificial sequence
  Synthetic oligonucletide
ggtaactagactttag

SEQ ID NO: 1331 - DNA, 16 bp, Artificial sequence
  Synthetic oligonucletide
agatctagaggttgta

SEQ ID NO: 1332 - DNA, 16 bp, Artificial sequence
  Synthetic oligonucletide
gacacttcatttgtgt

SEQ ID NO: 1333 - DNA, 16 bp, Artificial sequence
  Synthetic oligonucletide
gctttacaagtgtatt

SEQ ID NO: 1334 - DNA, 16 bp, Artificial sequence
  Synthetic oligonucletide
attcacctcaaaagag

SEQ ID NO: 1335 - DNA, 16 bp, Artificial sequence
  Synthetic oligonucletide
gtagaaatgccagact

SEQ ID NO: 1336 - DNA, 16 bp, Artificial sequence
  Synthetic oligonucletide
ctgataatgtgcatgt

SEQ ID NO: 1337 - DNA, 16 bp, Artificial sequence
  Synthetic oligonucletide
tcattagatttacgat

SEQ ID NO: 1338 - DNA, 16 bp, Artificial sequence
  Synthetic oligonucletide
tcagattatagcacaa

SEQ ID NO: 1339 - DNA, 16 bp, Artificial sequence
  Synthetic oligonucletide
atgttaaagctctgtc

SEQ ID NO: 1340 - DNA, 16 bp, Artificial sequence
  Synthetic oligonucletide
aaaacctttgttgtgg

SEQ ID NO: 1341 - DNA, 16 bp, Artificial sequence
  Synthetic oligonucletide
gaagatgtgtagcaga

SEQ ID NO: 1342 - DNA, 16 bp, Artificial sequence
  Synthetic oligonucletide
atggtaagctaggtaa

SEQ ID NO: 1343 - DNA, 16 bp, Artificial sequence
  Synthetic oligonucletide
aaccagtaaccaggat

SEQ ID NO: 1344 - DNA, 16 bp, Artificial sequence
  Synthetic oligonucletide
actaatgtcatatacc

SEQ ID NO: 1345 - DNA, 16 bp, Artificial sequence
  Synthetic oligonucletide
tagtagtagtttccat

SEQ ID NO: 1346 - DNA, 16 bp, Artificial sequence
  Synthetic oligonucletide
atacagagatatgccc

SEQ ID NO: 1347 - DNA, 16 bp, Artificial sequence
  Synthetic oligonucletide
acttttccatacttga

SEQ ID NO: 1348 - DNA, 16 bp, Artificial sequence
  Synthetic oligonucletide
atagatgggccaacaa

SEQ ID NO: 1349 - DNA, 16 bp, Artificial sequence
  Synthetic oligonucletide
taaggctacagtctga

SEQ ID NO: 1350 - DNA, 16 bp, Artificial sequence
  Synthetic oligonucletide
ttaaggtacagcttgt

SEQ ID NO: 1351 - DNA, 16 bp, Artificial sequence
  Synthetic oligonucletide
cttactttgaaaccac

SEQ ID NO: 1352 - DNA, 16 bp, Artificial sequence
  Synthetic oligonucletide
gacatagtgactgtta

SEQ ID NO: 1353 - DNA, 16 bp, Artificial sequence
  Synthetic oligonucletide
tgatacagatcagcaa

SEQ ID NO: 1354 - DNA, 16 bp, Artificial sequence
  Synthetic oligonucletide
cattagttattaaggt

SEQ ID NO: 1355 - DNA, 16 bp, Artificial sequence
  Synthetic oligonucletide
agatgtaaatagctca

SEQ ID NO: 1356 - DNA, 16 bp, Artificial sequence
  Synthetic oligonucletide
ctattaatgtgagtga

SEQ ID NO: 1357 - DNA, 16 bp, Artificial sequence
  Synthetic oligonucletide
aattaggatacctcag

SEQ ID NO: 1358 - DNA, 16 bp, Artificial sequence
  Synthetic oligonucletide
gtatatgctgagcatt

SEQ ID NO: 1359 - DNA, 16 bp, Artificial sequence
  Synthetic oligonucletide
gacaacttaaacatgc

SEQ ID NO: 1360 - DNA, 16 bp, Artificial sequence
  Synthetic oligonucletide
tagaaatttgtgagcc

SEQ ID NO: 1361 - DNA, 16 bp, Artificial sequence
  Synthetic oligonucletide
accaaagtcagcgaaa

SEQ ID NO: 1362 - DNA, 16 bp, Artificial sequence
  Synthetic oligonucletide
taccatttggttgata

SEQ ID NO: 1363 - DNA, 16 bp, Artificial sequence
  Synthetic oligonucletide
tgaattgcaagggtcc

SEQ ID NO: 1364 - DNA, 16 bp, Artificial sequence
  Synthetic oligonucletide
gagtaacagtggttgt

SEQ ID NO: 1365 - DNA, 16 bp, Artificial sequence
  Synthetic oligonucletide
atacaacaagctcccc

SEQ ID NO: 1366 - DNA, 16 bp, Artificial sequence
  Synthetic oligonucletide
catatgtcttagaaca

SEQ ID NO: 1367 - DNA, 16 bp, Artificial sequence
  Synthetic oligonucletide
gtaggctattaggtag

SEQ ID NO: 1368 - DNA, 16 bp, Artificial sequence
  Synthetic oligonucletide
gaagtggtctgttata

SEQ ID NO: 1369 - DNA, 16 bp, Artificial sequence
  Synthetic oligonucletide
ccaaagtttggtgaat

SEQ ID NO: 1370 - DNA, 16 bp, Artificial sequence
  Synthetic oligonucletide
tgggtaagaactttga

SEQ ID NO: 1371 - DNA, 16 bp, Artificial sequence
  Synthetic oligonucletide
attcactacagtgcct

SEQ ID NO: 1372 - DNA, 16 bp, Artificial sequence
  Synthetic oligonucletide
gccgtaaagacataca

SEQ ID NO: 1373 - DNA, 16 bp, Artificial sequence
  Synthetic oligonucletide
taacttggattttagg

SEQ ID NO: 1374 - DNA, 16 bp, Artificial sequence
  Synthetic oligonucletide
acgaattgtcagctcc

SEQ ID NO: 1375 - DNA, 16 bp, Artificial sequence
  Synthetic oligonucletide
attaatagctccagag

SEQ ID NO: 1376 - DNA, 16 bp, Artificial sequence
  Synthetic oligonucletide
tatgttgacccacttc

SEQ ID NO: 1377 - DNA, 16 bp, Artificial sequence
  Synthetic oligonucletide
tttaggtagcctggaa

SEQ ID NO: 1378 - DNA, 16 bp, Artificial sequence
  Synthetic oligonucletide
taacataagacaccta

SEQ ID NO: 1379 - DNA, 16 bp, Artificial sequence
  Synthetic oligonucletide
ggtaagtatcaggcat

SEQ ID NO: 1380 - DNA, 16 bp, Artificial sequence
  Synthetic oligonucletide
cagtatatagaggatg

SEQ ID NO: 1381 - DNA, 16 bp, Artificial sequence
  Synthetic oligonucletide
tataattaagaggacc

SEQ ID NO: 1382 - DNA, 16 bp, Artificial sequence
  Synthetic oligonucletide
gaatagggtagaattc

SEQ ID NO: 1383 - DNA, 16 bp, Artificial sequence
  Synthetic oligonucletide
ctacatgtactagaat

SEQ ID NO: 1384 - DNA, 16 bp, Artificial sequence
  Synthetic oligonucletide
aatagtatcctgtttc

SEQ ID NO: 1385 - DNA, 16 bp, Artificial sequence
  Synthetic oligonucletide
ccagaagtatgtgtac

SEQ ID NO: 1386 - DNA, 16 bp, Artificial sequence
  Synthetic oligonucletide
gaatacatatggtaac

SEQ ID NO: 1387 - DNA, 16 bp, Artificial sequence
  Synthetic oligonucletide
agtactgaagactgtc

SEQ ID NO: 1388 - DNA, 16 bp, Artificial sequence
  Synthetic oligonucletide
gcattaataggcagaa

SEQ ID NO: 1389 - DNA, 16 bp, Artificial sequence
  Synthetic oligonucletide
tgcagtataggtgtaa

SEQ ID NO: 1390 - DNA, 16 bp, Artificial sequence
  Synthetic oligonucletide
gactaaaactattaga

SEQ ID NO: 1391 - DNA, 16 bp, Artificial sequence
  Synthetic oligonucletide
gaagtcttaaggtttc

SEQ ID NO: 1392 - DNA, 16 bp, Artificial sequence
  Synthetic oligonucletide
tcaatattgatgttac

SEQ ID NO: 1393 - DNA, 16 bp, Artificial sequence
  Synthetic oligonucletide
aatgatgttgtatatg

SEQ ID NO: 1394 - DNA, 16 bp, Artificial sequence
  Synthetic oligonucletide
ttcagatgtaaatagc

SEQ ID NO: 1395 - DNA, 16 bp, Artificial sequence
  Synthetic oligonucletide
tttacaagatccaaca

SEQ ID NO: 1396 - DNA, 16 bp, Artificial sequence
  Synthetic oligonucletide
cgagtatattaggaaa

SEQ ID NO: 1397 - DNA, 16 bp, Artificial sequence
  Synthetic oligonucletide
atacatataacacgca

SEQ ID NO: 1398 - DNA, 16 bp, Artificial sequence
  Synthetic oligonucletide
taatacatataacacg

SEQ ID NO: 1399 - DNA, 16 bp, Artificial sequence
  Synthetic oligonucletide
gagtatattaggaaat

SEQ ID NO: 1400 - DNA, 16 bp, Artificial sequence
  Synthetic oligonucletide
ttcttatttgtagtga

SEQ ID NO: 1401 - DNA, 16 bp, Artificial sequence
  Synthetic oligonucletide
gttcttatttgtagtg

SEQ ID NO: 1402 - DNA, 16 bp, Artificial sequence
  Synthetic oligonucletide
tgggtgtagaaatgcc

SEQ ID NO: 1403 - DNA, 16 bp, Artificial sequence
  Synthetic oligonucletide
agttaagattttgcgg

SEQ ID NO: 1404 - DNA, 16 bp, Artificial sequence
  Synthetic oligonucletide
tgtagaaatgccagac

SEQ ID NO: 1405 - DNA, 16 bp, Artificial sequence
  Synthetic oligonucletide
catttgtcataggaat

SEQ ID NO: 1406 - DNA, 16 bp, Artificial sequence
  Synthetic oligonucletide
aattgtcagctcccct

SEQ ID NO: 1407 - DNA, 16 bp, Artificial sequence
  Synthetic oligonucletide
acagatgtgaggagtc

SEQ ID NO: 1408 - DNA, 16 bp, Artificial sequence
  Synthetic oligonucletide
ggtgtagaaatgccag

SEQ ID NO: 1409 - DNA, 16 bp, Artificial sequence
  Synthetic oligonucletide
gggtgtagaaatgcca

SEQ ID NO: 1410 - DNA, 16 bp, Artificial sequence
  Synthetic oligonucletide
ttggatgttaggctgg

SEQ ID NO: 1411 - DNA, 16 bp, Artificial sequence
  Synthetic oligonucletide
cagatgtgaggagtca

SEQ ID NO: 1412 - DNA, 16 bp, Artificial sequence
  Synthetic oligonucletide
taacaataagttttag

SEQ ID NO: 1413 - DNA, 16 bp, Artificial sequence
  Synthetic oligonucletide
tgtacacgagtatatt

SEQ ID NO: 1414 - DNA, 16 bp, Artificial sequence
  Synthetic oligonucletide
tatggtaacaataagt

SEQ ID NO: 1415 - DNA, 16 bp, Artificial sequence
  Synthetic oligonucletide
aacatttgtcatagga

SEQ ID NO: 1416 - DNA, 16 bp, Artificial sequence
  Synthetic oligonucletide
agagtattgtgttgta

SEQ ID NO: 1417 - DNA, 16 bp, Artificial sequence
  Synthetic oligonucletide
gtagtagtttccatca

SEQ ID NO: 1418 - DNA, 16 bp, Artificial sequence
  Synthetic oligonucletide
atggtaacaataagtt

SEQ ID NO: 1419 - DNA, 16 bp, Artificial sequence
  Synthetic oligonucletide
tagagtattgtgttgt

SEQ ID NO: 1420 - DNA, 16 bp, Artificial sequence
  Synthetic oligonucletide
acatttgtcataggaa

SEQ ID NO: 1421 - DNA, 16 bp, Artificial sequence
  Synthetic oligonucletide
gtacacgagtatatta

SEQ ID NO: 1422 - DNA, 16 bp, Artificial sequence
  Synthetic oligonucletide
agtagtagtttccatc

SEQ ID NO: 1423 - DNA, 16 bp, Artificial sequence
  Synthetic oligonucletide
tccaaagatatagtat

SEQ ID NO: 1424 - DNA, 16 bp, Artificial sequence
  Synthetic oligonucletide
agtaggctattaggta

SEQ ID NO: 1425 - DNA, 16 bp, Artificial sequence
  Synthetic oligonucletide
taatagtagtagtttc

SEQ ID NO: 1426 - DNA, 16 bp, Artificial sequence
  Synthetic oligonucletide
ggtttcatgattccaa

SEQ ID NO: 1427 - DNA, 16 bp, Artificial sequence
  Synthetic oligonucletide
aggtttcatgattcca

SEQ ID NO: 1428 - DNA, 16 bp, Artificial sequence
  Synthetic oligonucletide
ttaaggtttcatgatt

SEQ ID NO: 1429 - DNA, 16 bp, Artificial sequence
  Synthetic oligonucletide
aaatcaacagttgcat

SEQ ID NO: 1430 - DNA, 16 bp, Artificial sequence
  Synthetic oligonucletide
gaggaaatcaacagtt

SEQ ID NO: 1431 - DNA, 16 bp, Artificial sequence
  Synthetic oligonucletide
gtatttttggtggtat

SEQ ID NO: 1432 - DNA, 16 bp, Artificial sequence
  Synthetic oligonucletide
agtatttttggtggta

SEQ ID NO: 1433 - DNA, 16 bp, Artificial sequence
  Synthetic oligonucletide
ttcagtatttttggtg

SEQ ID NO: 1434 - DNA, 16 bp, Artificial sequence
  Synthetic oligonucletide
tcagtatttttggtgg

SEQ ID NO: 1435 - DNA, 16 bp, Artificial sequence
  Synthetic oligonucletide
cttcagtatttttggt

SEQ ID NO: 1436 - DNA, 16 bp, Artificial sequence
  Synthetic oligonucletide
tgttaagtactgaaga

SEQ ID NO: 1437 - DNA, 16 bp, Artificial sequence
  Synthetic oligonucletide
atgttaagtactgaag

SEQ ID NO: 1438 - DNA, 16 bp, Artificial sequence
  Synthetic oligonucletide
tgatgttaagtactga

SEQ ID NO: 1439 - DNA, 16 bp, Artificial sequence
  Synthetic oligonucletide
tttgatgttaagtact

SEQ ID NO: 1440 - DNA, 16 bp, Artificial sequence
  Synthetic oligonucletide
tgaatacatatggtaa

SEQ ID NO: 1441 - DNA, 16 bp, Artificial sequence
  Synthetic oligonucletide
aatgtcatataccatg

SEQ ID NO: 1442 - DNA, 16 bp, Artificial sequence
  Synthetic oligonucletide
taatgtcatataccat

SEQ ID NO: 1443 - DNA, 16 bp, Artificial sequence
  Synthetic oligonucletide
tgactaatgtcatata

SEQ ID NO: 1444 - DNA, 16 bp, Artificial sequence
  Synthetic oligonucletide
ttgactaatgtcatat

SEQ ID NO: 1445 - DNA, 16 bp, Artificial sequence
  Synthetic oligonucletide
tatcagtaaggtttat

SEQ ID NO: 1446 - DNA, 16 bp, Artificial sequence
  Synthetic oligonucletide
aagtcttaaggtttca

SEQ ID NO: 1447 - DNA, 16 bp, Artificial sequence
  Synthetic oligonucletide
tgtaatgctatgcata

SEQ ID NO: 1448 - DNA, 16 bp, Artificial sequence
  Synthetic oligonucletide
atgtaatgctatgcat

SEQ ID NO: 1449 - DNA, 16 bp, Artificial sequence
  Synthetic oligonucletide
agaatgtaatgctatg

SEQ ID NO: 1450 - DNA, 16 bp, Artificial sequence
  Synthetic oligonucletide
cattggatgttaggct

SEQ ID NO: 1451 - DNA, 16 bp, Artificial sequence
  Synthetic oligonucletide
tttttggacttgtggt

SEQ ID NO: 1452 - DNA, 16 bp, Artificial sequence
  Synthetic oligonucletide
ccttttttggacttgt

SEQ ID NO: 1453 - DNA, 16 bp, Artificial sequence
  Synthetic oligonucletide
cccttttttggacttg

SEQ ID NO: 1454 - DNA, 16 bp, Artificial sequence
  Synthetic oligonucletide
gttgtatatgctgagc

SEQ ID NO: 1455 - DNA, 16 bp, Artificial sequence
  Synthetic oligonucletide
atgttgtatatgctga

SEQ ID NO: 1456 - DNA, 16 bp, Artificial sequence
  Synthetic oligonucletide
acttaatagtagtagt

SEQ ID NO: 1457 - DNA, 16 bp, Artificial sequence
  Synthetic oligonucletide
tttttggtggtattcc

SEQ ID NO: 1458 - DNA, 16 bp, Artificial sequence
  Synthetic oligonucletide
gatttgatgttaagta

SEQ ID NO: 1459 - DNA, 16 bp, Artificial sequence
  Synthetic oligonucletide
tgtcatataccatgtt

SEQ ID NO: 1460 - DNA, 16 bp, Artificial sequence
  Synthetic oligonucletide
ttttgactaatgtcat

SEQ ID NO: 1461 - DNA, 16 bp, Artificial sequence
  Synthetic oligonucletide
taatgctatgcataaa

SEQ ID NO: 1462 - DNA, 16 bp, Artificial sequence
  Synthetic oligonucletide
attaagaatgtaatgc

SEQ ID NO: 1463 - DNA, 16 bp, Artificial sequence
  Synthetic oligonucletide
tacccttttttggact

SEQ ID NO: 1464 - DNA, 16 bp, Artificial sequence
  Synthetic oligonucletide
atttggagaggtaact

SEQ ID NO: 1465 - DNA, 16 bp, Artificial sequence
  Synthetic oligonucletide
tagttcagatgtaaat

SEQ ID NO: 1466 - DNA, 16 bp, Artificial sequence
  Synthetic oligonucletide
atataacacgcaaaat

SEQ ID NO: 1467 - DNA, 16 bp, Artificial sequence
  Synthetic oligonucletide
atattgtctaatttgg

SEQ ID NO: 1468 - DNA, 16 bp, Artificial sequence
  Synthetic oligonucletide
tatattaggaaattgc

SEQ ID NO: 1469 - DNA, 16 bp, Artificial sequence
  Synthetic oligonucletide
atttgtgagccatgtt

SEQ ID NO: 1470 - DNA, 16 bp, Artificial sequence
  Synthetic oligonucletide
actggaggataataac

SEQ ID NO: 1471 - DNA, 16 bp, Artificial sequence
  Synthetic oligonucletide
gtgtacacgagtatat

SEQ ID NO: 1472 - DNA, 16 bp, Artificial sequence
  Synthetic oligonucletide
gtatattaggaaattg

SEQ ID NO: 1473 - DNA, 16 bp, Artificial sequence
  Synthetic oligonucletide
gaaatgccagactcct

SEQ ID NO: 1474 - DNA, 16 bp, Artificial sequence
  Synthetic oligonucletide
caataagttttagtct

SEQ ID NO: 1475 - DNA, 16 bp, Artificial sequence
  Synthetic oligonucletide
ttaggctggaatggaa

SEQ ID NO: 1476 - DNA, 16 bp, Artificial sequence
  Synthetic oligonucletide
ttgtagtgagcaatag

SEQ ID NO: 1477 - DNA, 16 bp, Artificial sequence
  Synthetic oligonucletide
tggaggataataactt

SEQ ID NO: 1478 - DNA, 16 bp, Artificial sequence
  Synthetic oligonucletide
ggaggataataacttg

SEQ ID NO: 1479 - DNA, 16 bp, Artificial sequence
  Synthetic oligonucletide
taatttggagaggtaa

SEQ ID NO: 1480 - DNA, 16 bp, Artificial sequence
  Synthetic oligonucletide
gataataacttgacaa

SEQ ID NO: 1481 - DNA, 16 bp, Artificial sequence
  Synthetic oligonucletide
ttgtctaatttggaga

SEQ ID NO: 1482 - DNA, 16 bp, Artificial sequence
  Synthetic oligonucletide
tgtctaatttggagag

SEQ ID NO: 1483 - DNA, 16 bp, Artificial sequence
  Synthetic oligonucletide
attgtctaatttggag

SEQ ID NO: 1484 - DNA, 16 bp, Artificial sequence
  Synthetic oligonucletide
tatttgtagtgagcaa

SEQ ID NO: 1485 - DNA, 16 bp, Artificial sequence
  Synthetic oligonucletide
agaaatttgtgagcca

SEQ ID NO: 1486 - DNA, 16 bp, Artificial sequence
  Synthetic oligonucletide
gaaatttgtgagccat

SEQ ID NO: 1487 - DNA, 16 bp, Artificial sequence
  Synthetic oligonucletide
gatagaaatttgtgag

SEQ ID NO: 1488 - DNA, 16 bp, Artificial sequence
  Synthetic oligonucletide
aaatttgtgagccatg

SEQ ID NO: 1489 - DNA, 16 bp, Artificial sequence
  Synthetic oligonucletide
ttatttgtagtgagca

SEQ ID NO: 1490 - DNA, 16 bp, Artificial sequence
  Synthetic oligonucletide
atttgtagtgagcaat

SEQ ID NO: 1491 - DNA, 16 bp, Artificial sequence
  Synthetic oligonucletide
aagctgcagatctaga

SEQ ID NO: 1492 - DNA, 16 bp, Artificial sequence
  Synthetic oligonucletide
ttggtgaagacctgaa

SEQ ID NO: 1493 - DNA, 16 bp, Artificial sequence
  Synthetic oligonucletide
tgatgtggcaagctgc

SEQ ID NO: 1494 - DNA, 16 bp, Artificial sequence
  Synthetic oligonucletide
actgtcacatattaac

SEQ ID NO: 1495 - DNA, 16 bp, Artificial sequence
  Synthetic oligonucletide
ttcatgtttacaagat

SEQ ID NO: 1496 - DNA, 16 bp, Artificial sequence
  Synthetic oligonucletide
attgtcagctccccta

SEQ ID NO: 1497 - DNA, 16 bp, Artificial sequence
  Synthetic oligonucletide
ttttgcggacccacga

SEQ ID NO: 1498 - DNA, 16 bp, Artificial sequence
  Synthetic oligonucletide
ggtagtattgagaaag

SEQ ID NO: 1499 - DNA, 16 bp, Artificial sequence
  Synthetic oligonucletide
agctgcagatctagag

SEQ ID NO: 1500 - DNA, 16 bp, Artificial sequence
  Synthetic oligonucletide
tagattctgatagtta

SEQ ID NO: 1501 - DNA, 16 bp, Artificial sequence
  Synthetic oligonucletide
cttttccatacttgat

SEQ ID NO: 1502 - DNA, 16 bp, Artificial sequence
  Synthetic oligonucletide
ctgtcacatattaacc

SEQ ID NO: 1503 - DNA, 16 bp, Artificial sequence
  Synthetic oligonucletide
gtcagctcccctaacc

SEQ ID NO: 1504 - DNA, 16 bp, Artificial sequence
  Synthetic oligonucletide
cactgtcacatattaa

SEQ ID NO: 1505 - DNA, 16 bp, Artificial sequence
  Synthetic oligonucletide
taagtccttttataca

SEQ ID NO: 1506 - DNA, 16 bp, Artificial sequence
  Synthetic oligonucletide
ttgaggctcttcttat

SEQ ID NO: 1507 - DNA, 16 bp, Artificial sequence
  Synthetic oligonucletide
gcaagctgcagatcta

SEQ ID NO: 1508 - DNA, 16 bp, Artificial sequence
  Synthetic oligonucletide
tgtggcaagctgcaga

SEQ ID NO: 1509 - DNA, 16 bp, Artificial sequence
  Synthetic oligonucletide
acatgtactagaattc

SEQ ID NO: 1510 - DNA, 16 bp, Artificial sequence
  Synthetic oligonucletide
tgatgttgtatatgct

SEQ ID NO: 1511 - DNA, 16 bp, Artificial sequence
  Synthetic oligonucletide
tggatgttaggctgga

SEQ ID NO: 1512 - DNA, 16 bp, Artificial sequence
  Synthetic oligonucletide
gtattgtgttgtatga

SEQ ID NO: 1513 - DNA, 16 bp, Artificial sequence
  Synthetic oligonucletide
agtattgtgttgtatg

SEQ ID NO: 1514 - DNA, 16 bp, Artificial sequence
  Synthetic oligonucletide
attggatgttaggctg

SEQ ID NO: 1515 - DNA, 16 bp, Artificial sequence
  Synthetic oligonucletide
tcatgtttacaagatc

SEQ ID NO: 1516 - DNA, 16 bp, Artificial sequence
  Synthetic oligonucletide
cctgcattggatgtta

SEQ ID NO: 1517 - DNA, 16 bp, Artificial sequence
  Synthetic oligonucletide
gcctgcattggatgtt

SEQ ID NO: 1518 - DNA, 16 bp, Artificial sequence
  Synthetic oligonucletide
aatcaacagttgcatt

SEQ ID NO: 1519 - DNA, 16 bp, Artificial sequence
  Synthetic oligonucletide
ttgatgttaagtactg

SEQ ID NO: 1520 - DNA, 16 bp, Artificial sequence
  Synthetic oligonucletide
tttggacttgtggtaa

SEQ ID NO: 1521 - DNA, 16 bp, Artificial sequence
  Synthetic oligonucletide
tgttgtatatgctgag

SEQ ID NO: 1522 - DNA, 16 bp, Artificial sequence
  Synthetic oligonucletide
ttttggacttgtggta

SEQ ID NO: 1523 - DNA, 16 bp, Artificial sequence
  Synthetic oligonucletide
atgatgttgtatatgc

SEQ ID NO: 1524 - DNA, 16 bp, Artificial sequence
  Synthetic oligonucletide
agtagtttccatcatg

SEQ ID NO: 1525 - DNA, 16 bp, Artificial sequence
  Synthetic oligonucletide
ttgcctgcattggatg

SEQ ID NO: 1526 - DNA, 16 bp, Artificial sequence
  Synthetic oligonucletide
tggacttgtggtaata

SEQ ID NO: 1527 - DNA, 16 bp, Artificial sequence
  Synthetic oligonucletide
ttgtcagctcccctaa

SEQ ID NO: 1528 - DNA, 16 bp, Artificial sequence
  Synthetic oligonucletide
tttgggtgtagaaatg

SEQ ID NO: 1529 - DNA, 16 bp, Artificial sequence
  Synthetic oligonucletide
tttgtcataggaattg

SEQ ID NO: 1530 - DNA, 16 bp, Artificial sequence
  Synthetic oligonucletide
ttgtgttgtatgaagt

SEQ ID NO: 1531 - DNA, 16 bp, Artificial sequence
  Synthetic oligonucletide
tgtgtacacgagtata

SEQ ID NO: 1532 - DNA, 16 bp, Artificial sequence
  Synthetic oligonucletide
  misc_feature (5)..(5): bases at these positions are RNA
aggcucttcttatagc

SEQ ID NO: 1533 - DNA, 16 bp, Artificial sequence
  Synthetic oligonucletide
  misc_feature (5)..(5): bases at these positions are RNA
tagtuactacaaatag

SEQ ID NO: 1534 - DNA, 16 bp, Artificial sequence
  Synthetic oligonucletide
  misc_feature (5)..(5): bases at these positions are RNA
ttggugaagacctgaa

SEQ ID NO: 1535 - DNA, 16 bp, Artificial sequence
  Synthetic oligonucletide
  misc_feature (5)..(5): bases at these positions are RNA
aagcugcagatctaga

SEQ ID NO: 1536 - DNA, 16 bp, Artificial sequence
  Synthetic oligonucletide
  misc_feature (5)..(5): bases at these positions are RNA
agtauggccttacttt

SEQ ID NO: 1537 - DNA, 16 bp, Artificial sequence
  Synthetic oligonucletide
  misc_feature (5)..(5): bases at these positions are RNA
actgucacatattaac

SEQ ID NO: 1538 - DNA, 16 bp, Artificial sequence
  Synthetic oligonucletide
  misc_feature (5)..(5): bases at these positions are RNA
ataguatggtaagcta

SEQ ID NO: 1539 - DNA, 16 bp, Artificial sequence
  Synthetic oligonucletide
  misc_feature (5)..(5): bases at these positions are RNA
ataguaggctattagg

SEQ ID NO: 1540 - DNA, 16 bp, Artificial sequence
  Synthetic oligonucletide
  misc_feature (5)..(5): bases at these positions are RNA
actauaggcattaata

SEQ ID NO: 1541 - DNA, 16 bp, Artificial sequence
  Synthetic oligonucletide
  misc_feature (5)..(5): bases at these positions are RNA
ttaauaggcagaaatc

SEQ ID NO: 1542 - DNA, 16 bp, Artificial sequence
  Synthetic oligonucletide
  misc_feature (5)..(5): bases at these positions are RNA
tgttuacaagatccaa

SEQ ID NO: 1543 - DNA, 16 bp, Artificial sequence
  Synthetic oligonucletide
  misc_feature (5)..(5): bases at these positions are RNA
ttcaugtttacaagat

SEQ ID NO: 1544 - DNA, 16 bp, Artificial sequence
  Synthetic oligonucletide
  misc_feature (5)..(5): bases at these positions are RNA
gcatutcaatggttga

SEQ ID NO: 1545 - DNA, 16 bp, Artificial sequence
  Synthetic oligonucletide
  misc_feature (5)..(5): bases at these positions are RNA
gaacutgttggcagtg

SEQ ID NO: 1546 - DNA, 16 bp, Artificial sequence
  Synthetic oligonucletide
  misc_feature (5)..(5): bases at these positions are RNA
tactutgatacttggt

SEQ ID NO: 1547 - DNA, 16 bp, Artificial sequence
  Synthetic oligonucletide
  misc_feature (5)..(5): bases at these positions are RNA
atacutgattctcatc

SEQ ID NO: 1548 - DNA, 16 bp, Artificial sequence
  Synthetic oligonucletide
  misc_feature (5)..(5): bases at these positions are RNA
ctgauagttactacaa

SEQ ID NO: 1549 - DNA, 16 bp, Artificial sequence
  Synthetic oligonucletide
  misc_feature (5)..(5): bases at these positions are RNA
ttatuactttgatact

SEQ ID NO: 1550 - DNA, 16 bp, Artificial sequence
  Synthetic oligonucletide
  misc_feature (5)..(5): bases at these positions are RNA
attaugtaagagtatg

SEQ ID NO: 1551 - DNA, 16 bp, Artificial sequence
  Synthetic oligonucletide
  misc_feature (5)..(5): bases at these positions are RNA
atatuaaccaccagtt

SEQ ID NO: 1552 - DNA, 16 bp, Artificial sequence
  Synthetic oligonucletide
  misc_feature (5)..(5): bases at these positions are RNA
aagauatagtatggta

SEQ ID NO: 1553 - DNA, 16 bp, Artificial sequence
  Synthetic oligonucletide
  misc_feature (5)..(5): bases at these positions are RNA
gaatugtcagctcccc

SEQ ID NO: 1554 - DNA, 16 bp, Artificial sequence
  Synthetic oligonucletide
  misc_feature (5)..(5): bases at these positions are RNA
attgucagctccccta

SEQ ID NO: 1555 - DNA, 16 bp, Artificial sequence
  Synthetic oligonucletide
  misc_feature (5)..(5): bases at these positions are RNA
aggtutatggtcaata

SEQ ID NO: 1556 - DNA, 16 bp, Artificial sequence
  Synthetic oligonucletide
  misc_feature (5)..(5): bases at these positions are RNA
aggcuattaggtagtt

SEQ ID NO: 1557 - DNA, 16 bp, Artificial sequence
  Synthetic oligonucletide
  misc_feature (5)..(5): bases at these positions are RNA
aagautttgcggaccc

SEQ ID NO: 1558 - DNA, 16 bp, Artificial sequence
  Synthetic oligonucletide
  misc_feature (5)..(5): bases at these positions are RNA
tcaguaaggtttatgg

SEQ ID NO: 1559 - DNA, 16 bp, Artificial sequence
  Synthetic oligonucletide
  misc_feature (5)..(5): bases at these positions are RNA
attaugcagtataggt

SEQ ID NO: 1560 - DNA, 16 bp, Artificial sequence
  Synthetic oligonucletide
  misc_feature (5)..(5): bases at these positions are RNA
gtatugagaaagtctt

SEQ ID NO: 1561 - DNA, 16 bp, Artificial sequence
  Synthetic oligonucletide
  misc_feature (5)..(5): bases at these positions are RNA
cagaugtaaatagctc

SEQ ID NO: 1562 - DNA, 16 bp, Artificial sequence
  Synthetic oligonucletide
  misc_feature (5)..(5): bases at these positions are RNA
gtccutttatacatcc

SEQ ID NO: 1563 - DNA, 16 bp, Artificial sequence
  Synthetic oligonucletide
  misc_feature (5)..(5): bases at these positions are RNA
gtgtugtatgaagtct

SEQ ID NO: 1564 - DNA, 16 bp, Artificial sequence
  Synthetic oligonucletide
  misc_feature (5)..(5): bases at these positions are RNA
gtgtuattactttgat

SEQ ID NO: 1565 - DNA, 16 bp, Artificial sequence
  Synthetic oligonucletide
  misc_feature (5)..(5): bases at these positions are RNA
acttugatacttggtg

SEQ ID NO: 1566 - DNA, 16 bp, Artificial sequence
  Synthetic oligonucletide
  misc_feature (5)..(5): bases at these positions are RNA
cttgutggcagtgcag

SEQ ID NO: 1567 - DNA, 16 bp, Artificial sequence
  Synthetic oligonucletide
  misc_feature (5)..(5): bases at these positions are RNA
ctttuccatacttgat

SEQ ID NO: 1568 - DNA, 16 bp, Artificial sequence
  Synthetic oligonucletide
  misc_feature (5)..(5): bases at these positions are RNA
tagautctgatagtta

SEQ ID NO: 1569 - DNA, 16 bp, Artificial sequence
  Synthetic oligonucletide
  misc_feature (5)..(5): bases at these positions are RNA
ggttuatggtcaatag

SEQ ID NO: 1570 - DNA, 16 bp, Artificial sequence
  Synthetic oligonucletide
  misc_feature (5)..(5): bases at these positions are RNA
taaguccttttataca

SEQ ID NO: 1571 - DNA, 16 bp, Artificial sequence
  Synthetic oligonucletide
  misc_feature (5)..(5): bases at these positions are RNA
catguttacaagatcc

SEQ ID NO: 1572 - DNA, 16 bp, Artificial sequence
  Synthetic oligonucletide
  misc_feature (5)..(5): bases at these positions are RNA
cattucaatggttgag

SEQ ID NO: 1573 - DNA, 16 bp, Artificial sequence
  Synthetic oligonucletide
  misc_feature (5)..(5): bases at these positions are RNA
tcaauggttgaggctc

SEQ ID NO: 1574 - DNA, 16 bp, Artificial sequence
  Synthetic oligonucletide
  misc_feature (5)..(5): bases at these positions are RNA
atggutgaggctcttc

SEQ ID NO: 1575 - DNA, 16 bp, Artificial sequence
  Synthetic oligonucletide
  misc_feature (5)..(5): bases at these positions are RNA
ggcauttcaatggttg

SEQ ID NO: 1576 - DNA, 16 bp, Artificial sequence
  Synthetic oligonucletide
  misc_feature (5)..(5): bases at these positions are RNA
ttgauacttggtgaag

SEQ ID NO: 1577 - DNA, 16 bp, Artificial sequence
  Synthetic oligonucletide
  misc_feature (5)..(5): bases at these positions are RNA
tactuggtgaagacct

SEQ ID NO: 1578 - DNA, 16 bp, Artificial sequence
  Synthetic oligonucletide
  misc_feature (5)..(5): bases at these positions are RNA
attcugatagttacta

SEQ ID NO: 1579 - DNA, 16 bp, Artificial sequence
  Synthetic oligonucletide
  misc_feature (5)..(5): bases at these positions are RNA
gtacuagaattctgtg

SEQ ID NO: 1580 - DNA, 16 bp, Artificial sequence
  Synthetic oligonucletide
  misc_feature (5)..(5): bases at these positions are RNA
tatguaagagtatggc

SEQ ID NO: 1581 - DNA, 16 bp, Artificial sequence
  Synthetic oligonucletide
  misc_feature (5)..(5): bases at these positions are RNA
cacauattaaccacca

SEQ ID NO: 1582 - DNA, 16 bp, Artificial sequence
  Synthetic oligonucletide
  misc_feature (5)..(5): bases at these positions are RNA
catautaaccaccagt

SEQ ID NO: 1583 - DNA, 16 bp, Artificial sequence
  Synthetic oligonucletide
  misc_feature (5)..(5): bases at these positions are RNA
gatauagtatggtaag

SEQ ID NO: 1584 - DNA, 16 bp, Artificial sequence
  Synthetic oligonucletide
  misc_feature (5)..(5): bases at these positions are RNA
gctautaggtagttaa

SEQ ID NO: 1585 - DNA, 16 bp, Artificial sequence
  Synthetic oligonucletide
  misc_feature (5)..(5): bases at these positions are RNA
gattutgcggacccac

SEQ ID NO: 1586 - DNA, 16 bp, Artificial sequence
  Synthetic oligonucletide
  misc_feature (5)..(5): bases at these positions are RNA
ggatuatgcagtatag

SEQ ID NO: 1587 - DNA, 16 bp, Artificial sequence
  Synthetic oligonucletide
  misc_feature (5)..(5): bases at these positions are RNA
gcatuaataggcagaa

SEQ ID NO: 1588 - DNA, 16 bp, Artificial sequence
  Synthetic oligonucletide
  misc_feature (5)..(5): bases at these positions are RNA
gatguaaatagctcag

SEQ ID NO: 1589 - DNA, 16 bp, Artificial sequence
  Synthetic oligonucletide
  misc_feature (5)..(5): bases at these positions are RNA
ccttutatacatccca

SEQ ID NO: 1590 - DNA, 16 bp, Artificial sequence
  Synthetic oligonucletide
  misc_feature (5)..(5): bases at these positions are RNA
ccctuttttggacttg

SEQ ID NO: 1591 - DNA, 16 bp, Artificial sequence
  Synthetic oligonucletide
  misc_feature (5)..(5): bases at these positions are RNA
atgtugtatatgctga

SEQ ID NO: 1592 - DNA, 16 bp, Artificial sequence
  Synthetic oligonucletide
  misc_feature (5)..(5): bases at these positions are RNA
gttguatatgctgagc

SEQ ID NO: 1593 - DNA, 16 bp, Artificial sequence
  Synthetic oligonucletide
  misc_feature (5)..(5): bases at these positions are RNA
atgaugttgtatatgc

SEQ ID NO: 1594 - DNA, 16 bp, Artificial sequence
  Synthetic oligonucletide
  misc_feature (5)..(5): bases at these positions are RNA
gatgutgtatatgctg

SEQ ID NO: 1595 - DNA, 16 bp, Artificial sequence
  Synthetic oligonucletide
  misc_feature (5)..(5): bases at these positions are RNA
cgaguatattaggaaa

SEQ ID NO: 1596 - DNA, 16 bp, Artificial sequence
  Synthetic oligonucletide
  misc_feature (5)..(5): bases at these positions are RNA
tacauataacacgcaa

SEQ ID NO: 1597 - DNA, 16 bp, Artificial sequence
  Synthetic oligonucletide
  misc_feature (5)..(5): bases at these positions are RNA
ctaauttggagaggta

SEQ ID NO: 1598 - DNA, 16 bp, Artificial sequence
  Synthetic oligonucletide
  misc_feature (5)..(5): bases at these positions are RNA
aggauaataacttgac

SEQ ID NO: 1599 - DNA, 16 bp, Artificial sequence
  Synthetic oligonucletide
  misc_feature (5)..(5): bases at these positions are RNA
taatutggagaggtaa

SEQ ID NO: 1600 - DNA, 16 bp, Artificial sequence
  Synthetic oligonucletide
  misc_feature (5)..(5): bases at these positions are RNA
aaatutgtgagccatg

SEQ ID NO: 1601 - DNA, 16 bp, Artificial sequence
  Synthetic oligonucletide
  misc_feature (5)..(5): bases at these positions are RNA
attguctaatttggag

SEQ ID NO: 1602 - DNA, 16 bp, Artificial sequence
  Synthetic oligonucletide
  misc_feature (5)..(5): bases at these positions are RNA
tgtcuaatttggagag

SEQ ID NO: 1603 - DNA, 16 bp, Artificial sequence
  Synthetic oligonucletide
  misc_feature (5)..(5): bases at these positions are RNA
gaaauttgtgagccat

SEQ ID NO: 1604 - DNA, 16 bp, Artificial sequence
  Synthetic oligonucletide
  misc_feature (5)..(5): bases at these positions are RNA
atgtuaggctggaatg

SEQ ID NO: 1605 - DNA, 16 bp, Artificial sequence
  Synthetic oligonucletide
  misc_feature (5)..(5): bases at these positions are RNA
tattugtagtgagcaa

SEQ ID NO: 1606 - DNA, 16 bp, Artificial sequence
  Synthetic oligonucletide
  misc_feature (5)..(5): bases at these positions are RNA
cttauttgtagtgagc

SEQ ID NO: 1607 - DNA, 16 bp, Artificial sequence
  Synthetic oligonucletide
  misc_feature (5)..(5): bases at these positions are RNA
ttctuatttgtagtga

SEQ ID NO: 1608 - DNA, 16 bp, Artificial sequence
  Synthetic oligonucletide
  misc_feature (5)..(5): bases at these positions are RNA
ttatutgtagtgagca

SEQ ID NO: 1609 - DNA, 16 bp, Artificial sequence
  Synthetic oligonucletide
  misc_feature (5)..(5): bases at these positions are RNA
gttcutatttgtagtg

SEQ ID NO: 1610 - DNA, 16 bp, Artificial sequence
  Synthetic oligonucletide
  misc_feature (5)..(5): bases at these positions are RNA
tggaugttaggctgga

SEQ ID NO: 1611 - DNA, 16 bp, Artificial sequence
  Synthetic oligonucletide
  misc_feature (5)..(5): bases at these positions are RNA
ggtguagaaatgccag

SEQ ID NO: 1612 - DNA, 16 bp, Artificial sequence
  Synthetic oligonucletide
  misc_feature (5)..(5): bases at these positions are RNA
gatgutaggctggaat

SEQ ID NO: 1613 - DNA, 16 bp, Artificial sequence
  Synthetic oligonucletide
  misc_feature (5)..(5): bases at these positions are RNA
tagtuaagattttgcg

SEQ ID NO: 1614 - DNA, 16 bp, Artificial sequence
  Synthetic oligonucletide
  misc_feature (5)..(5): bases at these positions are RNA
tgggugtagaaatgcc

SEQ ID NO: 1615 - DNA, 16 bp, Artificial sequence
  Synthetic oligonucletide
  misc_feature (5)..(5): bases at these positions are RNA
cagaugtgaggagtca

SEQ ID NO: 1616 - DNA, 16 bp, Artificial sequence
  Synthetic oligonucletide
  misc_feature (5)..(5): bases at these positions are RNA
cgaautgtcagctccc

SEQ ID NO: 1617 - DNA, 16 bp, Artificial sequence
  Synthetic oligonucletide
  misc_feature (5)..(5): bases at these positions are RNA
acatutgtcataggaa

SEQ ID NO: 1618 - DNA, 16 bp, Artificial sequence
  Synthetic oligonucletide
  misc_feature (5)..(5): bases at these positions are RNA
cattugtcataggaat

SEQ ID NO: 1619 - DNA, 16 bp, Artificial sequence
  Synthetic oligonucletide
  misc_feature (5)..(5): bases at these positions are RNA
tagguagttaagattt

SEQ ID NO: 1620 - DNA, 16 bp, Artificial sequence
  Synthetic oligonucletide
  misc_feature (5)..(5): bases at these positions are RNA
gtagutaagattttgc

SEQ ID NO: 1621 - DNA, 16 bp, Artificial sequence
  Synthetic oligonucletide
  misc_feature (5)..(5): bases at these positions are RNA
aacauttgtcatagga

SEQ ID NO: 1622 - DNA, 16 bp, Artificial sequence
  Synthetic oligonucletide
  misc_feature (5)..(5): bases at these positions are RNA
agtautgtgttgtatg

SEQ ID NO: 1623 - DNA, 16 bp, Artificial sequence
  Synthetic oligonucletide
  misc_feature (5)..(5): bases at these positions are RNA
gtatugtgttgtatga

SEQ ID NO: 1624 - DNA, 16 bp, Artificial sequence
  Synthetic oligonucletide
  misc_feature (5)..(5): bases at these positions are RNA
atgguaacaataagtt

SEQ ID NO: 1625 - DNA, 16 bp, Artificial sequence
  Synthetic oligonucletide
  misc_feature (5)..(5): bases at these positions are RNA
agaguattgtgttgta

SEQ ID NO: 1626 - DNA, 16 bp, Artificial sequence
  Synthetic oligonucletide
  misc_feature (5)..(5): bases at these positions are RNA
gatguaatagatgggc

SEQ ID NO: 1627 - DNA, 16 bp, Artificial sequence
  Synthetic oligonucletide
  misc_feature (5)..(5): bases at these positions are RNA
tagaugtaatagatgg

SEQ ID NO: 1628 - DNA, 16 bp, Artificial sequence
  Synthetic oligonucletide
  misc_feature (5)..(5): bases at these positions are RNA
ttacuttgatacttgg

SEQ ID NO: 1629 - DNA, 16 bp, Artificial sequence
  Synthetic oligonucletide
  misc_feature (5)..(5): bases at these positions are RNA
tttauggtcaatagta

SEQ ID NO: 1630 - DNA, 16 bp, Artificial sequence
  Synthetic oligonucletide
  misc_feature (5)..(5): bases at these positions are RNA
taaguactgaagactg

SEQ ID NO: 1631 - DNA, 16 bp, Artificial sequence
  Synthetic oligonucletide
  misc_feature (5)..(5): bases at these positions are RNA
gattugatgttaagta

SEQ ID NO: 1632 - DNA, 16 bp, Artificial sequence
  Synthetic oligonucletide
  misc_feature (5)..(5): bases at these positions are RNA
ttttuggtggtattcc

SEQ ID NO: 1633 - DNA, 16 bp, Artificial sequence
  Synthetic oligonucletide
  misc_feature (5)..(5): bases at these positions are RNA
tatautaggaaattgc

SEQ ID NO: 1634 - DNA, 16 bp, Artificial sequence
  Synthetic oligonucletide
  misc_feature (5)..(5): bases at these positions are RNA
tagtucagatgtaaat

SEQ ID NO: 1635 - DNA, 16 bp, Artificial sequence
  Synthetic oligonucletide
  misc_feature (5)..(5): bases at these positions are RNA
tgtauatgctgagcat

SEQ ID NO: 1636 - DNA, 16 bp, Artificial sequence
  Synthetic oligonucletide
  misc_feature (5)..(5): bases at these positions are RNA
gaaaugccagactcct

SEQ ID NO: 1637 - DNA, 16 bp, Artificial sequence
  Synthetic oligonucletide
  misc_feature (5)..(5): bases at these positions are RNA
atatugtctaatttgg

SEQ ID NO: 1638 - DNA, 16 bp, Artificial sequence
  Synthetic oligonucletide
  misc_feature (5)..(5): bases at these positions are RNA
gtaauagatgggccaa

SEQ ID NO: 1639 - DNA, 16 bp, Artificial sequence
  Synthetic oligonucletide
  misc_feature (5)..(5): bases at these positions are RNA
tttgucataggaattg

SEQ ID NO: 1640 - DNA, 16 bp, Artificial sequence
  Synthetic oligonucletide
  misc_feature (5)..(5): bases at these positions are RNA
tgtguacacgagtata

SEQ ID NO: 1641 - DNA, 16 bp, Artificial sequence
  Synthetic oligonucletide
  misc_feature (5)..(5): bases at these positions are RNA
agtauggtaagctagg

SEQ ID NO: 1642 - DNA, 16 bp, Artificial sequence
  Synthetic oligonucletide
  misc_feature (5)..(5): bases at these positions are RNA
atgtutacaagatcca

SEQ ID NO: 1643 - DNA, 16 bp, Artificial sequence
  Synthetic oligonucletide
  misc_feature (5)..(5): bases at these positions are RNA
tgcautggatgttagg

SEQ ID NO: 1644 - DNA, 16 bp, Artificial sequence
  Synthetic oligonucletide
  misc_feature (5)..(5): bases at these positions are RNA
gcatuggatgttaggc

SEQ ID NO: 1645 - DNA, 16 bp, Artificial sequence
  Synthetic oligonucletide
  misc_feature (5)..(5): bases at these positions are RNA
ataguagtagtttcca

SEQ ID NO: 1646 - DNA, 16 bp, Artificial sequence
  Synthetic oligonucletide
  misc_feature (5)..(5): bases at these positions are RNA
gtaguagtttccatca

SEQ ID NO: 1647 - DNA, 16 bp, Artificial sequence
  Synthetic oligonucletide
  misc_feature (5)..(5): bases at these positions are RNA
aagguttatggtcaat

SEQ ID NO: 1648 - DNA, 16 bp, Artificial sequence
  Synthetic oligonucletide
  misc_feature (5)..(5): bases at these positions are RNA
ggttucatgattccaa

SEQ ID NO: 1649 - DNA, 16 bp, Artificial sequence
  Synthetic oligonucleotide
  misc_feature (5)..(5): bases at these positions are RNA
aagguttcatgattcc

SEQ ID NO: 1650 - DNA, 16 bp, Artificial sequence
  Synthetic oligonucletide
  misc_feature (5)..(5): bases at these positions are RNA
aggtutcatgattcca

SEQ ID NO: 1651 - DNA, 16 bp, Artificial sequence
  Synthetic oligonucletide
  misc_feature (5)..(5): bases at these positions are RNA
gtatutttggtggtat

SEQ ID NO: 1652 - DNA, 16 bp, Artificial sequence
  Synthetic oligonucletide
  misc_feature (5)..(5): bases at these positions are RNA
gaaaucaacagttgca

SEQ ID NO: 1653 - DNA, 16 bp, Artificial sequence
  Synthetic oligonucletide
  misc_feature (5)..(5): bases at these positions are RNA
agtauttttggtggta

SEQ ID NO: 1654 - DNA, 16 bp, Artificial sequence
  Synthetic oligonucletide
  misc_feature (5)..(5): bases at these positions are RNA
tcaguatttttggtgg

SEQ ID NO: 1655 - DNA, 16 bp, Artificial sequence
  Synthetic oligonucletide
  misc_feature (5)..(5): bases at these positions are RNA
tgaauacatatggtaa

SEQ ID NO: 1656 - DNA, 16 bp, Artificial sequence
  Synthetic oligonucletide
  misc_feature (5)..(5): bases at these positions are RNA
ttgaugttaagtactg

SEQ ID NO: 1657 - DNA, 16 bp, Artificial sequence
  Synthetic oligonucletide
  misc_feature (5)..(5): bases at these positions are RNA
atgtuaagtactgaag

SEQ ID NO: 1658 - DNA, 16 bp, Artificial sequence
  Synthetic oligonucletide
  misc_feature (5)..(5): bases at these positions are RNA
gatgutaagtactgaa

SEQ ID NO: 1659 - DNA, 16 bp, Artificial sequence
  Synthetic oligonucletide
  misc_feature (5)..(5): bases at these positions are RNA
ctaaugtcatatacca

SEQ ID NO: 1660 - DNA, 16 bp, Artificial sequence
  Synthetic oligonucletide
  misc_feature (5)..(5): bases at these positions are RNA
aatgucatataccatg

SEQ ID NO: 1661 - DNA, 16 bp, Artificial sequence
  Synthetic oligonucletide
  misc_feature (5)..(5): bases at these positions are RNA
tgacuaatgtcatata

SEQ ID NO: 1662 - DNA, 16 bp, Artificial sequence
  Synthetic oligonucletide
  misc_feature (5)..(5): bases at these positions are RNA
gaagucttaaggtttc

SEQ ID NO: 1663 - DNA, 16 bp, Artificial sequence
  Synthetic oligonucletide
  misc_feature (5)..(5): bases at these positions are RNA
agaaugtaatgctatg

SEQ ID NO: 1664 - DNA, 16 bp, Artificial sequence
  Synthetic oligonucletide
  misc_feature (5)..(5): bases at these positions are RNA
gtctuaaggtttcatg

SEQ ID NO: 1665 - DNA, 16 bp, Artificial sequence
  Synthetic oligonucletide
  misc_feature (5)..(5): bases at these positions are RNA
agtcutaaggtttcat

SEQ ID NO: 1666 - DNA, 16 bp, Artificial sequence
  Synthetic oligonucletide
  misc_feature (5)..(5): bases at these positions are RNA
ctttuttggacttgtg

SEQ ID NO: 1667 - DNA, 16 bp, Artificial sequence
  Synthetic oligonucletide
  misc_feature (5)..(5): bases at these positions are RNA
ccttutttggacttgt

SEQ ID NO: 1668 - DNA, 16 bp, Artificial sequence
  Synthetic oligonucletide
  misc_feature (5)..(5): bases at these positions are RNA
ttttutggacttgtgg

SEQ ID NO: 1669 - DNA, 16 bp, Artificial sequence
  Synthetic oligonucletide
  misc_feature (5)..(5): bases at these positions are RNA
ttttuggacttgtggt

SEQ ID NO: 1670 - DNA, 17 bp, Artificial sequence
  Synthetic oligonucletide
gtagttaagattttgcg

SEQ ID NO: 1671 - DNA, 17 bp, Artificial sequence
  Synthetic oligonucletide
cacgagtatattaggaa

SEQ ID NO: 1672 - DNA, 17 bp, Artificial sequence
  Synthetic oligonucletide
agatatagtatggtaag

SEQ ID NO: 1673 - DNA, 17 bp, Artificial sequence
  Synthetic oligonucletide
caaagatatagtatggt

SEQ ID NO: 1674 - DNA, 17 bp, Artificial sequence
  Synthetic oligonucletide
ccaaagatatagtatgg

SEQ ID NO: 1675 - DNA, 17 bp, Artificial sequence
  Synthetic oligonucletide
tccaaagatatagtatg

SEQ ID NO: 1676 - DNA, 17 bp, Artificial sequence
  Synthetic oligonucletide
attactttgatacttgg

SEQ ID NO: 1677 - DNA, 17 bp, Artificial sequence
  Synthetic oligonucletide
ccatacttgattctcat

SEQ ID NO: 1678 - DNA, 17 bp, Artificial sequence
  Synthetic oligonucletide
acacgagtatattagga

SEQ ID NO: 1679 - DNA, 17 bp, Artificial sequence
  Synthetic oligonucletide
aagatatagtatggtaa

SEQ ID NO: 1680 - DNA, 17 bp, Artificial sequence
  Synthetic oligonucletide
aaagatatagtatggta

SEQ ID NO: 1681 - DNA, 17 bp, Artificial sequence
  Synthetic oligonucletide
ggtagttaagattttgc

SEQ ID NO: 1682 - DNA, 17 bp, Artificial sequence
  Synthetic oligonucletide
ttccaaagatatagtat

SEQ ID NO: 1683 - DNA, 17 bp, Artificial sequence
  Synthetic oligonucletide
tattactttgatacttg

SEQ ID NO: 1684 - DNA, 17 bp, Artificial sequence
  Synthetic oligonucletide
tccatacttgattctca

SEQ ID NO: 1685 - DNA, 17 bp, Artificial sequence
  Synthetic oligonucletide
tacacgagtatattagg

SEQ ID NO: 1686 - DNA, 18 bp, Artificial sequence
  Synthetic oligonucletide
agatatagtatggtaagc

SEQ ID NO: 1687 - DNA, 18 bp, Artificial sequence
  Synthetic oligonucletide
caaagatatagtatggta

SEQ ID NO: 1688 - DNA, 18 bp, Artificial sequence
  Synthetic oligonucletide
gtagttaagattttgcgg

SEQ ID NO: 1689 - DNA, 18 bp, Artificial sequence
  Synthetic oligonucletide
cacgagtatattaggaaa

SEQ ID NO: 1690 - DNA, 18 bp, Artificial sequence
  Synthetic oligonucletide
ccaaagatatagtatggt

SEQ ID NO: 1691 - DNA, 18 bp, Artificial sequence
  Synthetic oligonucletide
tccaaagatatagtatgg

SEQ ID NO: 1692 - DNA, 18 bp, Artificial sequence
  Synthetic oligonucletide
aagatatagtatggtaag

SEQ ID NO: 1693 - DNA, 18 bp, Artificial sequence
  Synthetic oligonucletide
aaagatatagtatggtaa

SEQ ID NO: 1694 - DNA, 18 bp, Artificial sequence
  Synthetic oligonucletide
attactttgatacttggt

SEQ ID NO: 1695 - DNA, 18 bp, Artificial sequence
  Synthetic oligonucletide
ccatacttgattctcatc

SEQ ID NO: 1696 - DNA, 18 bp, Artificial sequence
  Synthetic oligonucletide
acacgagtatattaggaa

SEQ ID NO: 1697 - DNA, 18 bp, Artificial sequence
  Synthetic oligonucletide
ggtagttaagattttgcg

SEQ ID NO: 1698 - DNA, 18 bp, Artificial sequence
  Synthetic oligonucletide
ttccaaagatatagtatg

SEQ ID NO: 1699 - DNA, 18 bp, Artificial sequence
  Synthetic oligonucletide
tccatacttgattctcat

SEQ ID NO: 1700 - DNA, 18 bp, Artificial sequence
  Synthetic oligonucletide
tacacgagtatattagga

SEQ ID NO: 1701 - DNA, 18 bp, Artificial sequence
  Synthetic oligonucletide
tattactttgatacttgg

SEQ ID NO: 1702 - DNA, 20 bp, Artificial sequence
  Synthetic oligonucletide
aggtagttaagattttgcgg

SEQ ID NO: 1703 - DNA, 20 bp, Artificial sequence
  Synthetic oligonucletide
tacacgagtatattaggaaa

SEQ ID NO: 1704 - DNA, 20 bp, Artificial sequence
  Synthetic oligonucletide
aaagatatagtatggtaagc

SEQ ID NO: 1705 - DNA, 20 bp, Artificial sequence
  Synthetic oligonucletide
tccaaagatatagtatggta

SEQ ID NO: 1706 - DNA, 20 bp, Artificial sequence
  Synthetic oligonucletide
ttccaaagatatagtatggt

SEQ ID NO: 1707 - DNA, 20 bp, Artificial sequence
  Synthetic oligonucletide
attccaaagatatagtatgg

SEQ ID NO: 1708 - DNA, 20 bp, Artificial sequence
  Synthetic oligonucletide
ttccatacttgattctcatc

SEQ ID NO: 1709 - DNA, 20 bp, Artificial sequence
  Synthetic oligonucletide
gtacacgagtatattaggaa

SEQ ID NO: 1710 - DNA, 20 bp, Artificial sequence
  Synthetic oligonucletide
caaagatatagtatggtaag

SEQ ID NO: 1711 - DNA, 20 bp, Artificial sequence
  Synthetic oligonucletide
ccaaagatatagtatggtaa

SEQ ID NO: 1712 - DNA, 20 bp, Artificial sequence
  Synthetic oligonucletide
ttattactttgatacttggt

SEQ ID NO: 1713 - RNA, 23 nt, Artificial sequence
  Synthetic oligonucletide
ucaucacaguauagaguauugug

SEQ ID NO: 1714 - RNA, 23 nt, Artificial sequence
  Synthetic oligonucletide
gguguuuagcuggggaguuuucu

SEQ ID NO: 1715 - RNA, 23 nt, Artificial sequence
  Synthetic oligonucletide
ucugacucugucacccaguuuau

SEQ ID NO: 1716 - RNA, 23 nt, Artificial sequence
  Synthetic oligonucletide
gguagccuuggcagcugugauca

SEQ ID NO: 1717 - RNA, 23 nt, Artificial sequence
  Synthetic oligonucletide
guguuguaugaagucuuacgggu

SEQ ID NO: 1718 - RNA, 23 nt, Artificial sequence
  Synthetic oligonucletide
gagauaacugucuucuuuuaggu

SEQ ID NO: 1719 - RNA, 23 nt, Artificial sequence
  Synthetic oligonucletide
uuucuccaugauaccagcaggac

SEQ ID NO: 1720 - RNA, 23 nt, Artificial sequence
  Synthetic oligonucletide
aaaagcuggcagccaaauaugag

SEQ ID NO: 1721 - RNA, 23 nt, Artificial sequence
  Synthetic oligonucletide
aaguggucgagagaaagauaaaa

SEQ ID NO: 1722 - RNA, 23 nt, Artificial sequence
  Synthetic oligonucletide
gacaggaagucugaaguuuuaag

SEQ ID NO: 1723 - RNA, 23 nt, Artificial sequence
  Synthetic oligonucletide
uugaggcucuucuuauagcugag

SEQ ID NO: 1724 - RNA, 23 nt, Artificial sequence
  Synthetic oligonucletide
gagcgagugagguauuggacuuu

SEQ ID NO: 1725 - RNA, 23 nt, Artificial sequence
  Synthetic oligonucletide
uuguugaggcauuucaaugguug

SEQ ID NO: 1726 - RNA, 23 nt, Artificial sequence
  Synthetic oligonucletide
uucuguagcuuuugacgugcuug

SEQ ID NO: 1727 - RNA, 23 nt, Artificial sequence
  Synthetic oligonucletide
uagcagaacuucagagaagcauc

SEQ ID NO: 1728 - RNA, 23 nt, Artificial sequence
  Synthetic oligonucletide
aucacgaugauacagaucagcaa

SEQ ID NO: 1729 - RNA, 23 nt, Artificial sequence
  Synthetic oligonucletide
gacagaaauugauaaauagauuc

SEQ ID NO: 1730 - RNA, 23 nt, Artificial sequence
  Synthetic oligonucletide
caagagacauauuaagaugagac

SEQ ID NO: 1731 - RNA, 23 nt, Artificial sequence
  Synthetic oligonucletide
agcugcagaucuagagguuguag

SEQ ID NO: 1732 - RNA, 23 nt, Artificial sequence
  Synthetic oligonucletide
cuguuauacaauauuguuuuccu

SEQ ID NO: 1733 - RNA, 23 nt, Artificial sequence
  Synthetic oligonucletide
gauuuuaagcugauguggcaagc

SEQ ID NO: 1734 - RNA, 23 nt, Artificial sequence
  Synthetic oligonucletide
ccugucugcaugggaugacagau

SEQ ID NO: 1735 - RNA, 23 nt, Artificial sequence
  Synthetic oligonucletide
ucuucuacucaggaaguggucug

SEQ ID NO: 1736 - RNA, 23 nt, Artificial sequence
  Synthetic oligonucletide
ugaccuuuucacaaagaaacucu

SEQ ID NO: 1737 - RNA, 23 nt, Artificial sequence
  Synthetic oligonucletide
aucaacaguugcauuuuauacac

SEQ ID NO: 1738 - RNA, 23 nt, Artificial sequence
  Synthetic oligonucletide
cacuuauuuugaaguuaauuuuu

SEQ ID NO: 1739 - RNA, 23 nt, Artificial sequence
  Synthetic oligonucletide
auaaguuuuagucuuaaucuuga

SEQ ID NO: 1740 - RNA, 23 nt, Artificial sequence
  Synthetic oligonucletide
cauguuuacaagauccaacagau

SEQ ID NO: 1741 - RNA, 23 nt, Artificial sequence
  Synthetic oligonucletide
gaugaauacauaugguaacaaua

SEQ ID NO: 1742 - RNA, 23 nt, Artificial sequence
  Synthetic oligonucletide
uuugaaaauaaagcccuuuucau

SEQ ID NO: 1743 - RNA, 23 nt, Artificial sequence
  Synthetic oligonucletide
acuaaacucuucaucuucagaaa

SEQ ID NO: 1744 - RNA, 23 nt, Artificial sequence
  Synthetic oligonucletide
caaaagaguaaaaauaaugcuuu

SEQ ID NO: 1745 - RNA, 23 nt, Artificial sequence
  Synthetic oligonucletide
uugugagccauguugaggaaauc

SEQ ID NO: 1746 - RNA, 23 nt, Artificial sequence
  Synthetic oligonucletide
guuggcagugcaguuuuaaaacu

SEQ ID NO: 1747 - RNA, 23 nt, Artificial sequence
  Synthetic oligonucletide
uuuauauaugaagugaacuuguu

SEQ ID NO: 1748 - RNA, 23 nt, Artificial sequence
  Synthetic oligonucletide
aaaagauuugggauagaaauuug

SEQ ID NO: 1749 - RNA, 23 nt, Artificial sequence
  Synthetic oligonucletide
uacuuugauacuuggugaagacc

SEQ ID NO: 1750 - RNA, 23 nt, Artificial sequence
  Synthetic oligonucletide
ugacacuucauuuguguuauuac

SEQ ID NO: 1751 - RNA, 23 nt, Artificial sequence
  Synthetic oligonucletide
aauauaaauuauauucaccucaa

SEQ ID NO: 1752 - RNA, 23 nt, Artificial sequence
  Synthetic oligonucletide
accugaaaaauacuuaguauuaa

SEQ ID NO: 1753 - RNA, 23 nt, Artificial sequence
  Synthetic oligonucletide
uaaagaagcuuuuacauuguaau

SEQ ID NO: 1754 - RNA, 23 nt, Artificial sequence
  Synthetic oligonucletide
guuauuacuuugauacuugguga

SEQ ID NO: 1755 - RNA, 23 nt, Artificial sequence
  Synthetic oligonucletide
uguagauucugauaguuacuaca

SEQ ID NO: 1756 - RNA, 23 nt, Artificial sequence
  Synthetic oligonucletide
caguggacuauuuugaauaauga

SEQ ID NO: 1757 - RNA, 23 nt, Artificial sequence
  Synthetic oligonucletide
agauaacagaugugaggagucag

SEQ ID NO: 1758 - RNA, 23 nt, Artificial sequence
  Synthetic oligonucletide
auacaauuucuguuuuagaaugu

SEQ ID NO: 1759 - RNA, 23 nt, Artificial sequence
  Synthetic oligonucletide
acaaauaguucuuuauaauaaga

SEQ ID NO: 1760 - RNA, 23 nt, Artificial sequence
  Synthetic oligonucletide
guuaauguggcauagaaaaaaua

SEQ ID NO: 1761 - RNA, 23 nt, Artificial sequence
  Synthetic oligonucletide
cuuacuuuuccauacuugauucu

SEQ ID NO: 1762 - RNA, 23 nt, Artificial sequence
  Synthetic oligonucletide
uuauuauguaagaguauggccuu

SEQ ID NO: 1763 - RNA, 23 nt, Artificial sequence
  Synthetic oligonucletide
ucucaucaacuuuaaaagauguu

SEQ ID NO: 1764 - RNA, 23 nt, Artificial sequence
  Synthetic oligonucletide
cauacuugauucucaucaacuuu

SEQ ID NO: 1765 - RNA, 23 nt, Artificial sequence
  Synthetic oligonucletide
aaaauuacuuaaaaggaauuuua

SEQ ID NO: 1766 - RNA, 23 nt, Artificial sequence
  Synthetic oligonucletide
gaauucugugauucuuugaaaaa

SEQ ID NO: 1767 - RNA, 23 nt, Artificial sequence
  Synthetic oligonucletide
uaugucuuagaacagauuuauga

SEQ ID NO: 1768 - RNA, 23 nt, Artificial sequence
  Synthetic oligonucletide
auuagugauaugacuaaucucac

SEQ ID NO: 1769 - RNA, 23 nt, Artificial sequence
  Synthetic oligonucletide
cacugucacauauuaaccaccag

SEQ ID NO: 1770 - RNA, 23 nt, Artificial sequence
  Synthetic oligonucletide
uuagauucuguuguuaguauauu

SEQ ID NO: 1771 - RNA, 23 nt, Artificial sequence
  Synthetic oligonucletide
caguucucaucuguugaucauau

SEQ ID NO: 1772 - RNA, 23 nt, Artificial sequence
  Synthetic oligonucletide
ugauuuaccuacauguacuagaa

SEQ ID NO: 1773 - RNA, 23 nt, Artificial sequence
  Synthetic oligonucletide
uaguaugguaagcuagguaacuc

SEQ ID NO: 1774 - RNA, 23 nt, Artificial sequence
  Synthetic oligonucletide
uacagugccuuaaaugaagauua

SEQ ID NO: 1775 - RNA, 23 nt, Artificial sequence
  Synthetic oligonucletide
cucuagcucagauaauucacuac

SEQ ID NO: 1776 - RNA, 23 nt, Artificial sequence
  Synthetic oligonucletide
gauauaguaugguaagcuaggua

SEQ ID NO: 1777 - RNA, 23 nt, Artificial sequence
  Synthetic oligonucletide
ugauuccaaagauauaguauggu

SEQ ID NO: 1778 - RNA, 23 nt, Artificial sequence
  Synthetic oligonucletide
ccaaagauauaguaugguaagcu

SEQ ID NO: 1779 - RNA, 23 nt, Artificial sequence
  Synthetic oligonucletide
cugcauuggauguuaggcuggaa

SEQ ID NO: 1780 - RNA, 23 nt, Artificial sequence
  Synthetic oligonucletide
guuucaugauuccaaagauauag

SEQ ID NO: 1781 - RNA, 23 nt, Artificial sequence
  Synthetic oligonucletide
aaaucuuuuauuuuccuugccug

SEQ ID NO: 1782 - RNA, 23 nt, Artificial sequence
  Synthetic oligonucletide
gaauggaagacaaccugcaaaau

SEQ ID NO: 1783 - RNA, 23 nt, Artificial sequence
  Synthetic oligonucletide
auauauuuuucugucacuggaaa

SEQ ID NO: 1784 - RNA, 23 nt, Artificial sequence
  Synthetic oligonucletide
aaucauucugaagucuuaagguu

SEQ ID NO: 1785 - RNA, 23 nt, Artificial sequence
  Synthetic oligonucletide
uuuaaaaaauacuugagauaaua

SEQ ID NO: 1786 - RNA, 23 nt, Artificial sequence
  Synthetic oligonucletide
cuaauaauuaguuaauauuugga

SEQ ID NO: 1787 - RNA, 23 nt, Artificial sequence
  Synthetic oligonucletide
ggagagagaauucauauauuuuu

SEQ ID NO: 1788 - RNA, 23 nt, Artificial sequence
  Synthetic oligonucletide
auguaauagaugggccaacaagu

SEQ ID NO: 1789 - RNA, 23 nt, Artificial sequence
  Synthetic oligonucletide
uguucaagggucagcuguagaug

SEQ ID NO: 1790 - RNA, 23 nt, Artificial sequence
  Synthetic oligonucletide
aguucauuucaaaauauaaucua

SEQ ID NO: 1791 - RNA, 23 nt, Artificial sequence
  Synthetic oligonucletide
gucagcuccccuaacccccaugu

SEQ ID NO: 1792 - RNA, 23 nt, Artificial sequence
  Synthetic oligonucletide
uaguuaagauuuugcggacccac

SEQ ID NO: 1793 - RNA, 23 nt, Artificial sequence
  Synthetic oligonucletide
auuuacuguuuauguuaucagua

SEQ ID NO: 1794 - RNA, 23 nt, Artificial sequence
  Synthetic oligonucletide
guaagguuuauggucaauaguag

SEQ ID NO: 1795 - RNA, 23 nt, Artificial sequence
  Synthetic oligonucletide
uaggcuauuagguaguuaagauu

SEQ ID NO: 1796 - RNA, 23 nt, Artificial sequence
  Synthetic oligonucletide
auuuugcggacccacgaauuguc

SEQ ID NO: 1797 - RNA, 23 nt, Artificial sequence
  Synthetic oligonucletide
uauuuucucuuucuuaugauuuu

SEQ ID NO: 1798 - RNA, 23 nt, Artificial sequence
  Synthetic oligonucletide
uagcuuacuuuauuguaggaaua

SEQ ID NO: 1799 - RNA, 23 nt, Artificial sequence
  Synthetic oligonucletide
cauuuaaugaauaguaaauauau

SEQ ID NO: 1800 - RNA, 23 nt, Artificial sequence
  Synthetic oligonucletide
aacacgcaaaauauguguuaauu

SEQ ID NO: 1801 - RNA, 23 nt, Artificial sequence
  Synthetic oligonucletide
uuucuaaauaacauuuucucuag

SEQ ID NO: 1802 - RNA, 23 nt, Artificial sequence
  Synthetic oligonucletide
auauaguguauaauacauauaac

SEQ ID NO: 1803 - RNA, 23 nt, Artificial sequence
  Synthetic oligonucletide
cuccucugccuacucaaugugaa

SEQ ID NO: 1804 - RNA, 23 nt, Artificial sequence
  Synthetic oligonucletide
ccccacaccccuaagacaagacu

SEQ ID NO: 1805 - RNA, 23 nt, Artificial sequence
  Synthetic oligonucletide
ucuuccuccccaucuuucuccuc

SEQ ID NO: 1806 - RNA, 23 nt, Artificial sequence
  Synthetic oligonucletide
cuuuuauguugacccacuuccau

SEQ ID NO: 1807 - RNA, 23 nt, Artificial sequence
  Synthetic oligonucletide
gaagacaaugagaaugaagacuu

SEQ ID NO: 1808 - RNA, 23 nt, Artificial sequence
  Synthetic oligonucletide
acugcaagaccaacgccuucucu

SEQ ID NO: 1809 - RNA, 23 nt, Artificial sequence
  Synthetic oligonucletide
ugaauauucuuucccccacuccc

SEQ ID NO: 1810 - RNA, 23 nt, Artificial sequence
  Synthetic oligonucletide
ugcaaggguccacuuauacauga

SEQ ID NO: 1811 - RNA, 23 nt, Artificial sequence
  Synthetic oligonucletide
auccuauuacaguugacccuuga

SEQ ID NO: 1812 - RNA, 23 nt, Artificial sequence
  Synthetic oligonucletide
agaggaagaaaaauagcuauauc

SEQ ID NO: 1813 - RNA, 23 nt, Artificial sequence
  Synthetic oligonucletide
augcuuaccauuugguugauaga

SEQ ID NO: 1814 - RNA, 23 nt, Artificial sequence
  Synthetic oligonucletide
ugaacaacaagggcuugaauugc

SEQ ID NO: 1815 - RNA, 23 nt, Artificial sequence
  Synthetic oligonucletide
aaauuuauucaucaagaaaauaa

SEQ ID NO: 1816 - RNA, 23 nt, Artificial sequence
  Synthetic oligonucletide
uuauuggaagauguucugaaaug

SEQ ID NO: 1817 - RNA, 23 nt, Artificial sequence
  Synthetic oligonucletide
ggaucuauaauuuagcucaguag

SEQ ID NO: 1818 - RNA, 23 nt, Artificial sequence
  Synthetic oligonucletide
uaauuauaaauagcauagcugga

SEQ ID NO: 1819 - RNA, 23 nt, Artificial sequence
  Synthetic oligonucletide
auggucagaggagaaauugaaaa

SEQ ID NO: 1820 - RNA, 23 nt, Artificial sequence
  Synthetic oligonucletide
uagaguggacugcaaaauagaug

SEQ ID NO: 1821 - RNA, 23 nt, Artificial sequence
  Synthetic oligonucletide
uuaccaaaguuuggugaauauau

SEQ ID NO: 1822 - RNA, 23 nt, Artificial sequence
  Synthetic oligonucletide
gauuaugcaguauagguguaaac

SEQ ID NO: 1823 - RNA, 23 nt, Artificial sequence
  Synthetic oligonucletide
uauuuuccagcacucaauuuuac

SEQ ID NO: 1824 - RNA, 23 nt, Artificial sequence
  Synthetic oligonucletide
aacuauuuuagacuuaauuuuaa

SEQ ID NO: 1825 - RNA, 23 nt, Artificial sequence
  Synthetic oligonucletide
uaaacuuuagucaacuuaaauua

SEQ ID NO: 1826 - RNA, 23 nt, Artificial sequence
  Synthetic oligonucletide
uacuucaguuguuuuaugaguua

SEQ ID NO: 1827 - RNA, 23 nt, Artificial sequence
  Synthetic oligonucletide
aacugaaauuaaaauuguuggau

SEQ ID NO: 1828 - RNA, 23 nt, Artificial sequence
  Synthetic oligonucletide
uauauuaguaacaugucuucaac

SEQ ID NO: 1829 - RNA, 23 nt, Artificial sequence
  Synthetic oligonucletide
uaguaaccauguuuuagaagaua

SEQ ID NO: 1830 - RNA, 23 nt, Artificial sequence
  Synthetic oligonucletide
auaugguuaauuacacauccucu

SEQ ID NO: 1831 - RNA, 23 nt, Artificial sequence
  Synthetic oligonucletide
auugauguuacauauucuuuuag

SEQ ID NO: 1832 - RNA, 23 nt, Artificial sequence
  Synthetic oligonucletide
ucuacucuuuuaauaauaguuau

SEQ ID NO: 1833 - RNA, 23 nt, Artificial sequence
  Synthetic oligonucletide
uaucccugaaccaaacacuuucc

SEQ ID NO: 1834 - RNA, 23 nt, Artificial sequence
  Synthetic oligonucletide
ucucucauggguucagaaaauuu

SEQ ID NO: 1835 - RNA, 23 nt, Artificial sequence
  Synthetic oligonucletide
uauugaguuagcaacacuugugu

SEQ ID NO: 1836 - RNA, 23 nt, Artificial sequence
  Synthetic oligonucletide
uguaagaaaccaaggucaauauu

SEQ ID NO: 1837 - RNA, 23 nt, Artificial sequence
  Synthetic oligonucletide
gaauuuccagcuuguagaugagg

SEQ ID NO: 1838 - RNA, 23 nt, Artificial sequence
  Synthetic oligonucletide
uuuaauagugucuccuucacuau

SEQ ID NO: 1839 - RNA, 23 nt, Artificial sequence
  Synthetic oligonucletide
uccacuccccaucucuaguaucu

SEQ ID NO: 1840 - RNA, 23 nt, Artificial sequence
  Synthetic oligonucletide
acuaaaaccagugaggugagugu

SEQ ID NO: 1841 - RNA, 23 nt, Artificial sequence
  Synthetic oligonucletide
aggcgucacuuaagaaaucucug

SEQ ID NO: 1842 - RNA, 23 nt, Artificial sequence
  Synthetic oligonucletide
uguaucaccuguuguuuauaagc

SEQ ID NO: 1843 - RNA, 23 nt, Artificial sequence
  Synthetic oligonucletide
cugcccuucuguucuucagauau

SEQ ID NO: 1844 - RNA, 23 nt, Artificial sequence
  Synthetic oligonucletide
agcuuucuacuuguuuuuaggaa

SEQ ID NO: 1845 - RNA, 23 nt, Artificial sequence
  Synthetic oligonucletide
acuuucuguauugguaauuuacu

SEQ ID NO: 1846 - RNA, 23 nt, Artificial sequence
  Synthetic oligonucletide
aaucaguucaaauuuuccacuug

SEQ ID NO: 1847 - RNA, 23 nt, Artificial sequence
  Synthetic oligonucletide
aaaauauuguaacaaacagugua

SEQ ID NO: 1848 - RNA, 23 nt, Artificial sequence
  Synthetic oligonucletide
guuauuucuguuuacugagaaaa

SEQ ID NO: 1849 - RNA, 23 nt, Artificial sequence
  Synthetic oligonucletide
uuguuuuuaagacuagggauacu

SEQ ID NO: 1850 - RNA, 23 nt, Artificial sequence
  Synthetic oligonucletide
guaaucaaaggaauaugacuaau

SEQ ID NO: 1851 - RNA, 23 nt, Artificial sequence
  Synthetic oligonucletide
aaugaagaacaaaaaaauuaguu

SEQ ID NO: 1852 - RNA, 23 nt, Artificial sequence
  Synthetic oligonucletide
uaugaugaagaauaauuauuuaa

SEQ ID NO: 1853 - RNA, 23 nt, Artificial sequence
  Synthetic oligonucletide
uaaagaguuuauucuacuuuaua

SEQ ID NO: 1854 - RNA, 23 nt, Artificial sequence
  Synthetic oligonucletide
gauuuuaauuucuaucaaagaau

SEQ ID NO: 1855 - RNA, 23 nt, Artificial sequence
  Synthetic oligonucletide
auaauuugaguuauaguauucug

SEQ ID NO: 1856 - RNA, 23 nt, Artificial sequence
  Synthetic oligonucletide
cuguaauccucacagaauaagau

SEQ ID NO: 1857 - RNA, 23 nt, Artificial sequence
  Synthetic oligonucletide
auuguuuuuagugcccuguaaau

SEQ ID NO: 1858 - RNA, 23 nt, Artificial sequence
  Synthetic oligonucletide
cuauaguagaacauauuugagca

SEQ ID NO: 1859 - RNA, 23 nt, Artificial sequence
  Synthetic oligonucletide
aauuaagauaagaacuuauucua

SEQ ID NO: 1860 - RNA, 23 nt, Artificial sequence
  Synthetic oligonucletide
auaucuuauucuuuacacuuuau

SEQ ID NO: 1861 - RNA, 23 nt, Artificial sequence
  Synthetic oligonucletide
gcauuuaguauauuaaauuuuaa

SEQ ID NO: 1862 - RNA, 23 nt, Artificial sequence
  Synthetic oligonucletide
uaaaaauaaauuguuuucuuaua

SEQ ID NO: 1863 - RNA, 23 nt, Artificial sequence
  Synthetic oligonucletide
uuaaacaaauauauauucuuaac

SEQ ID NO: 1864 - RNA, 23 nt, Artificial sequence
  Synthetic oligonucletide
ugaguuuucaagaacauucauuu

SEQ ID NO: 1865 - RNA, 23 nt, Artificial sequence
  Synthetic oligonucletide
aaccaauuaaaauauaaaaggca

SEQ ID NO: 1866 - RNA, 23 nt, Artificial sequence
  Synthetic oligonucletide
gcaacauuaagcauuuuaaaauu

SEQ ID NO: 1867 - RNA, 23 nt, Artificial sequence
  Synthetic oligonucletide
acauucauuuuaauauagugauu

SEQ ID NO: 1868 - RNA, 23 nt, Artificial sequence
  Synthetic oligonucletide
uauagugauucugauuugcauua

SEQ ID NO: 1869 - RNA, 23 nt, Artificial sequence
  Synthetic oligonucletide
auagaguauuguguuguaugaag

SEQ ID NO: 1870 - RNA, 23 nt, Artificial sequence
  Synthetic oligonucletide
gcagcugugaucaucacaguaua

SEQ ID NO: 1871 - RNA, 23 nt, Artificial sequence
  Synthetic oligonucletide
aagucuuacggguguuuagcugg

SEQ ID NO: 1872 - RNA, 23 nt, Artificial sequence
  Synthetic oligonucletide
agccaaauaugagauaacugucu

SEQ ID NO: 1873 - RNA, 23 nt, Artificial sequence
  Synthetic oligonucletide
ucuucuuuuagguagccuuggca

SEQ ID NO: 1874 - RNA, 23 nt, Artificial sequence
  Synthetic oligonucletide
uggggaguuuucugacucuguca

SEQ ID NO: 1875 - RNA, 23 nt, Artificial sequence
  Synthetic oligonucletide
auuucaaugguugaggcucuucu

SEQ ID NO: 1876 - RNA, 23 nt, Artificial sequence
  Synthetic oligonucletide
cugaaguuuuaaguggucgagag

SEQ ID NO: 1877 - RNA, 23 nt, Artificial sequence
  Synthetic oligonucletide
auaccagcaggacaggaagucug

SEQ ID NO: 1878 - RNA, 23 nt, Artificial sequence
  Synthetic oligonucletide
gagaaagauaaaaagcuggcagc

SEQ ID NO: 1879 - RNA, 23 nt, Artificial sequence
  Synthetic oligonucletide
gguauuggacuuucuccaugaua

SEQ ID NO: 1880 - RNA, 23 nt, Artificial sequence
  Synthetic oligonucletide
ucuuauagcugagcgagugaggu

SEQ ID NO: 1881 - RNA, 23 nt, Artificial sequence
  Synthetic oligonucletide
auuaagaugagacagaaauugau

SEQ ID NO: 1882 - RNA, 23 nt, Artificial sequence
  Synthetic oligonucletide
uacagaucagcaagagacauauu

SEQ ID NO: 1883 - RNA, 23 nt, Artificial sequence
  Synthetic oligonucletide
uuugacgugcuuguugaggcauu

SEQ ID NO: 1884 - RNA, 23 nt, Artificial sequence
  Synthetic oligonucletide
cuagagguuguagcagaacuuca

SEQ ID NO: 1885 - RNA, 23 nt, Artificial sequence
  Synthetic oligonucletide
ucagagaagcaucacgaugauac

SEQ ID NO: 1886 - RNA, 23 nt, Artificial sequence
  Synthetic oligonucletide
gauaaauagauucuguagcuuuu

SEQ ID NO: 1887 - RNA, 23 nt, Artificial sequence
  Synthetic oligonucletide
acaaagaaacucuucuacucagg

SEQ ID NO: 1888 - RNA, 23 nt, Artificial sequence
  Synthetic oligonucletide
ugauguggcaagcugcagaucua

SEQ ID NO: 1889 - RNA, 23 nt, Artificial sequence
  Synthetic oligonucletide
gucuuaaucuugaccuuuucaca

SEQ ID NO: 1890 - RNA, 23 nt, Artificial sequence
  Synthetic oligonucletide
auauuguuuuccugucugcaugg

SEQ ID NO: 1891 - RNA, 23 nt, Artificial sequence
  Synthetic oligonucletide
aggaaguggucuguuauacaaua

SEQ ID NO: 1892 - RNA, 23 nt, Artificial sequence
  Synthetic oligonucletide
ugggaugacagauuuuaagcuga

SEQ ID NO: 1893 - RNA, 23 nt, Artificial sequence
  Synthetic oligonucletide
uaugguaacaauaaguuuuaguc

SEQ ID NO: 1894 - RNA, 23 nt, Artificial sequence
  Synthetic oligonucletide
gcauuuuauacacuuauuuugaa

SEQ ID NO: 1895 - RNA, 23 nt, Artificial sequence
  Synthetic oligonucletide
agauccaacagaugaauacauau

SEQ ID NO: 1896 - RNA, 23 nt, Artificial sequence
  Synthetic oligonucletide
aagcccuuuucauguuuacaaga

SEQ ID NO: 1897 - RNA, 23 nt, Artificial sequence
  Synthetic oligonucletide
gaaguuaauuuuugaaaauaaag

SEQ ID NO: 1898 - RNA, 23 nt, Artificial sequence
  Synthetic oligonucletide
uguugaggaaaucaacaguugca

SEQ ID NO: 1899 - RNA, 23 nt, Artificial sequence
  Synthetic oligonucletide
aagugaacuuguuggcagugcag

SEQ ID NO: 1900 - RNA, 23 nt, Artificial sequence
  Synthetic oligonucletide
caguuuuaaaacuaaacucuuca

SEQ ID NO: 1901 - RNA, 23 nt, Artificial sequence
  Synthetic oligonucletide
aaaauaaugcuuuauauaugaag

SEQ ID NO: 1902 - RNA, 23 nt, Artificial sequence
  Synthetic oligonucletide
auauucaccucaaaagaguaaaa

SEQ ID NO: 1903 - RNA, 23 nt, Artificial sequence
  Synthetic oligonucletide
ggauagaaauuugugagccaugu

SEQ ID NO: 1904 - RNA, 23 nt, Artificial sequence
  Synthetic oligonucletide
ucaucuucagaaaagauuuggga

SEQ ID NO: 1905 - RNA, 23 nt, Artificial sequence
  Synthetic oligonucletide
uacuuaguauuaaagaagcuuuu

SEQ ID NO: 1906 - RNA, 23 nt, Artificial sequence
  Synthetic oligonucletide
uuuugaauaaugacacuucauuu

SEQ ID NO: 1907 - RNA, 23 nt, Artificial sequence
  Synthetic oligonucletide
ugugaggagucaguggacuauuu

SEQ ID NO: 1908 - RNA, 23 nt, Artificial sequence
  Synthetic oligonucletide
cuuggugaagaccugaaaaauac

SEQ ID NO: 1909 - RNA, 23 nt, Artificial sequence
  Synthetic oligonucletide
cuuuauaauaagauaacagaugu

SEQ ID NO: 1910 - RNA, 23 nt, Artificial sequence
  Synthetic oligonucletide
uuuacauuguaauauaaauuaua

SEQ ID NO: 1911 - RNA, 23 nt, Artificial sequence
  Synthetic oligonucletide
cauagaaaaaauacaauuucugu

SEQ ID NO: 1912 - RNA, 23 nt, Artificial sequence
  Synthetic oligonucletide
uguuuuagaauguagauucugau

SEQ ID NO: 1913 - RNA, 23 nt, Artificial sequence
  Synthetic oligonucletide
uuuaaaagauguuaauguggcau

SEQ ID NO: 1914 - RNA, 23 nt, Artificial sequence
  Synthetic oligonucletide
agaguauggccuuacuuuuccau

SEQ ID NO: 1915 - RNA, 23 nt, Artificial sequence
  Synthetic oligonucletide
gauaguuacuacaaauaguucuu

SEQ ID NO: 1916 - RNA, 23 nt, Artificial sequence
  Synthetic oligonucletide
aaaaggaauuuuauuauguaaga

SEQ ID NO: 1917 - RNA, 23 nt, Artificial sequence
  Synthetic oligonucletide
aacagauuuaugauuuaccuaca

SEQ ID NO: 1918 - RNA, 23 nt, Artificial sequence
  Synthetic oligonucletide
uauuaaccaccaguucucaucug

SEQ ID NO: 1919 - RNA, 23 nt, Artificial sequence
  Synthetic oligonucletide
auucuuugaaaaaauuacuuaaa

SEQ ID NO: 1920 - RNA, 23 nt, Artificial sequence
  Synthetic oligonucletide
cuguugaucauaugucuuagaac

SEQ ID NO: 1921 - RNA, 23 nt, Artificial sequence
  Synthetic oligonucletide
ugacuaaucucacugucacauau

SEQ ID NO: 1922 - RNA, 23 nt, Artificial sequence
  Synthetic oligonucletide
acauguacuagaauucugugauu

SEQ ID NO: 1923 - RNA, 23 nt, Artificial sequence
  Synthetic oligonucletide
aagucuuaagguuucaugauucc

SEQ ID NO: 1924 - RNA, 23 nt, Artificial sequence
  Synthetic oligonucletide
gauaauucacuacagugccuuaa

SEQ ID NO: 1925 - RNA, 23 nt, Artificial sequence
  Synthetic oligonucletide
uaaaugaagauuagauucuguug

SEQ ID NO: 1926 - RNA, 23 nt, Artificial sequence
  Synthetic oligonucletide
agcuagguaacucuagcucagau

SEQ ID NO: 1927 - RNA, 23 nt, Artificial sequence
  Synthetic oligonucletide
ugcaaaaucauucugaagucuua

SEQ ID NO: 1928 - RNA, 23 nt, Artificial sequence
  Synthetic oligonucletide
uuguuaguauauuagugauauga

SEQ ID NO: 1929 - RNA, 23 nt, Artificial sequence
  Synthetic oligonucletide
uuuuccuugccugcauuggaugu

SEQ ID NO: 1930 - RNA, 23 nt, Artificial sequence
  Synthetic oligonucletide
uucauauauuuuuaaaaaauacu

SEQ ID NO: 1931 - RNA, 23 nt, Artificial sequence
  Synthetic oligonucletide
uguuaggcuggaauggaagacaa

SEQ ID NO: 1932 - RNA, 23 nt, Artificial sequence
  Synthetic oligonucletide
caaccugcaaaaucauucugaag

SEQ ID NO: 1933 - RNA, 23 nt, Artificial sequence
  Synthetic oligonucletide
acuugagauaauauauuuuucug

SEQ ID NO: 1934 - RNA, 23 nt, Artificial sequence
  Synthetic oligonucletide
cugucacuggaaaucuuuuauuu

SEQ ID NO: 1935 - RNA, 23 nt, Artificial sequence
  Synthetic oligonucletide
ugggccaacaaguucauuucaaa

SEQ ID NO: 1936 - RNA, 23 nt, Artificial sequence
  Synthetic oligonucletide
guuaauauuuggagagagaauuc

SEQ ID NO: 1937 - RNA, 23 nt, Artificial sequence
  Synthetic oligonucletide
cuaacccccauguucaaggguca

SEQ ID NO: 1938 - RNA, 23 nt, Artificial sequence
  Synthetic oligonucletide
aaaauauaaucuaauaauuaguu

SEQ ID NO: 1939 - RNA, 23 nt, Artificial sequence
  Synthetic oligonucletide
gaauugucagcuccccuaacccc

SEQ ID NO: 1940 - RNA, 23 nt, Artificial sequence
  Synthetic oligonucletide
ucagcuguagauguaauagaugg

SEQ ID NO: 1941 - RNA, 23 nt, Artificial sequence
  Synthetic oligonucletide
uaauacauauaacacgcaaaaua

SEQ ID NO: 1942 - RNA, 23 nt, Artificial sequence
  Synthetic oligonucletide
auauguguuaauuuacuguuuau

SEQ ID NO: 1943 - RNA, 23 nt, Artificial sequence
  Synthetic oligonucletide
uauuguaggaauauaguguauaa

SEQ ID NO: 1944 - RNA, 23 nt, Artificial sequence
  Synthetic oligonucletide
uauguuaucaguaagguuuaugg

SEQ ID NO: 1945 - RNA, 23 nt, Artificial sequence
  Synthetic oligonucletide
cccacgaauugucagcuccccua

SEQ ID NO: 1946 - RNA, 23 nt, Artificial sequence
  Synthetic oligonucletide
uggucaauaguaggcuauuaggu

SEQ ID NO: 1947 - RNA, 23 nt, Artificial sequence
  Synthetic oligonucletide
agaaugaagacuuuuauguugac

SEQ ID NO: 1948 - RNA, 23 nt, Artificial sequence
  Synthetic oligonucletide
auaguaaauauauuuucucuuuc

SEQ ID NO: 1949 - RNA, 23 nt, Artificial sequence
  Synthetic oligonucletide
uucuuaugauuuucuaaauaaca

SEQ ID NO: 1950 - RNA, 23 nt, Artificial sequence
  Synthetic oligonucletide
gacccacuuccauuuaaugaaua

SEQ ID NO: 1951 - RNA, 23 nt, Artificial sequence
  Synthetic oligonucletide
uacucaaugugaagacaaugaga

SEQ ID NO: 1952 - RNA, 23 nt, Artificial sequence
  Synthetic oligonucletide
acauuuucucuagcuuacuuuau

SEQ ID NO: 1953 - RNA, 23 nt, Artificial sequence
  Synthetic oligonucletide
gggcuugaauugcaaggguccac

SEQ ID NO: 1954 - RNA, 23 nt, Artificial sequence
  Synthetic oligonucletide
caucuuucuccuccucugccuac

SEQ ID NO: 1955 - RNA, 23 nt, Artificial sequence
  Synthetic oligonucletide
cuaagacaagacugcaagaccaa

SEQ ID NO: 1956 - RNA, 23 nt, Artificial sequence
  Synthetic oligonucletide
uucccccacuccccacaccccua

SEQ ID NO: 1957 - RNA, 23 nt, Artificial sequence
  Synthetic oligonucletide
cacuuauacaugaauauucuuuc

SEQ ID NO: 1958 - RNA, 23 nt, Artificial sequence
  Synthetic oligonucletide
caacgccuucucuuccuccccau

SEQ ID NO: 1959 - RNA, 23 nt, Artificial sequence
  Synthetic oligonucletide
aguugacccuugaacaacaaggg

SEQ ID NO: 1960 - RNA, 23 nt, Artificial sequence
  Synthetic oligonucletide
uuuagcucaguagaguggacugc

SEQ ID NO: 1961 - RNA, 23 nt, Artificial sequence
  Synthetic oligonucletide
uagcauagcuggaucuauaauuu

SEQ ID NO: 1962 - RNA, 23 nt, Artificial sequence
  Synthetic oligonucletide
aaauagcuauauccuauuacagu

SEQ ID NO: 1963 - RNA, 23 nt, Artificial sequence
  Synthetic oligonucletide
uuugguugauagaggaagaaaaa

SEQ ID NO: 1964 - RNA, 23 nt, Artificial sequence
  Synthetic oligonucletide
ugcaaaauagaugcuuaccauuu

SEQ ID NO: 1965 - RNA, 23 nt, Artificial sequence
  Synthetic oligonucletide
cacucaauuuuacuucaguuguu

SEQ ID NO: 1966 - RNA, 23 nt, Artificial sequence
  Synthetic oligonucletide
auguucugaaauggucagaggag

SEQ ID NO: 1967 - RNA, 23 nt, Artificial sequence
  Synthetic oligonucletide
guuuuaugaguuauuggaagaug

SEQ ID NO: 1968 - RNA, 23 nt, Artificial sequence
  Synthetic oligonucletide
aucaagaaaauaauuauaaauag

SEQ ID NO: 1969 - RNA, 23 nt, Artificial sequence
  Synthetic oligonucletide
auugaaaauuuauucaucaagaa

SEQ ID NO: 1970 - RNA, 23 nt, Artificial sequence
  Synthetic oligonucletide
gagaaauugaaaauuuauucauc

SEQ ID NO: 1971 - RNA, 23 nt, Artificial sequence
  Synthetic oligonucletide
acaugucuucaacugaaauuaaa

SEQ ID NO: 1972 - RNA, 23 nt, Artificial sequence
  Synthetic oligonucletide
aaaauuguuggauuaugcaguau

SEQ ID NO: 1973 - RNA, 23 nt, Artificial sequence
  Synthetic oligonucletide
ucaacuuaaauuaccaaaguuug

SEQ ID NO: 1974 - RNA, 23 nt, Artificial sequence
  Synthetic oligonucletide
gacuuaauuuuaaacuuuaguca

SEQ ID NO: 1975 - RNA, 23 nt, Artificial sequence
  Synthetic oligonucletide
uauagguguaaacuauuuuagac

SEQ ID NO: 1976 - RNA, 23 nt, Artificial sequence
  Synthetic oligonucletide
uuggugaauauauuuuccagcac

SEQ ID NO: 1977 - RNA, 23 nt, Artificial sequence
  Synthetic oligonucletide
caaggucaauauugauguuacau

SEQ ID NO: 1978 - RNA, 23 nt, Artificial sequence
  Synthetic oligonucletide
cauauucuuuuaguaaccauguu

SEQ ID NO: 1979 - RNA, 23 nt, Artificial sequence
  Synthetic oligonucletide
guuuuagaagauaugguuaauua

SEQ ID NO: 1980 - RNA, 23 nt, Artificial sequence
  Synthetic oligonucletide
auaguuauauuaguaacaugucu

SEQ ID NO: 1981 - RNA, 23 nt, Artificial sequence
  Synthetic oligonucletide
uuacacauccucuacucuuuuaa

SEQ ID NO: 1982 - RNA, 23 nt, Artificial sequence
  Synthetic oligonucletide
uaauaauaguuauauuaguaaca

SEQ ID NO: 1983 - RNA, 23 nt, Artificial sequence
  Synthetic oligonucletide
aucucuaguaucucucauggguu

SEQ ID NO: 1984 - RNA, 23 nt, Artificial sequence
  Synthetic oligonucletide
uaguaucucucauggguucagaa

SEQ ID NO: 1985 - RNA, 23 nt, Artificial sequence
  Synthetic oligonucletide
ucuccuucacuauugaguuagca

SEQ ID NO: 1986 - RNA, 23 nt, Artificial sequence
  Synthetic oligonucletide
ccaaacacuuuccacuccccauc

SEQ ID NO: 1987 - RNA, 23 nt, Artificial sequence
  Synthetic oligonucletide
guucagaaaauuuaauagugucu

SEQ ID NO: 1988 - RNA, 23 nt, Artificial sequence
  Synthetic oligonucletide
gcaacacuuguguaagaaaccaa

SEQ ID NO: 1989 - RNA, 23 nt, Artificial sequence
  Synthetic oligonucletide
uuguuuuuaggaauuuccagcuu

SEQ ID NO: 1990 - RNA, 23 nt, Artificial sequence
  Synthetic oligonucletide
cuuguagaugaggcgucacuuaa

SEQ ID NO: 1991 - RNA, 23 nt, Artificial sequence
  Synthetic oligonucletide
uaagaaaucucugcccuucuguu

SEQ ID NO: 1992 - RNA, 23 nt, Artificial sequence
  Synthetic oligonucletide
uuuaggaauuuccagcuuguaga

SEQ ID NO: 1993 - RNA, 23 nt, Artificial sequence
  Synthetic oligonucletide
guucuucagauaucccugaacca

SEQ ID NO: 1994 - RNA, 23 nt, Artificial sequence
  Synthetic oligonucletide
guuguuuauaagcuuucuacuug

SEQ ID NO: 1995 - RNA, 23 nt, Artificial sequence
  Synthetic oligonucletide
gaauaugacuaaucaguucaaau

SEQ ID NO: 1996 - RNA, 23 nt, Artificial sequence
  Synthetic oligonucletide
gacuagggauacuuucuguauug

SEQ ID NO: 1997 - RNA, 23 nt, Artificial sequence
  Synthetic oligonucletide
acaguguaaucaaaggaauauga

SEQ ID NO: 1998 - RNA, 23 nt, Artificial sequence
  Synthetic oligonucletide
uugguaauuuacuaaaaccagug

SEQ ID NO: 1999 - RNA, 23 nt, Artificial sequence
  Synthetic oligonucletide
gugaggugaguguaucaccuguu

SEQ ID NO: 2000 - RNA, 23 nt, Artificial sequence
  Synthetic oligonucletide
aauuuuccacuuguuuuuaagac

SEQ ID NO: 2001 - RNA, 23 nt, Artificial sequence
  Synthetic oligonucletide
uuuacugagaaaaauauuguaac

SEQ ID NO: 2002 - RNA, 23 nt, Artificial sequence
  Synthetic oligonucletide
aacaaacaguguaaucaaaggaa

SEQ ID NO: 2003 - RNA, 23 nt, Artificial sequence
  Synthetic oligonucletide
ucuaucaaagaaugaagaacaaa

SEQ ID NO: 2004 - RNA, 23 nt, Artificial sequence
  Synthetic oligonucletide
aauaagauuuuaauuucuaucaa

SEQ ID NO: 2005 - RNA, 23 nt, Artificial sequence
  Synthetic oligonucletide
aaaaaaauuaguuauuucuguuu

SEQ ID NO: 2006 - RNA, 23 nt, Artificial sequence
  Synthetic oligonucletide
cacagaauaagauuuuaauuucu

SEQ ID NO: 2007 - RNA, 23 nt, Artificial sequence
  Synthetic oligonucletide
uuauuuaaagaguuuauucuacu

SEQ ID NO: 2008 - RNA, 23 nt, Artificial sequence
  Synthetic oligonucletide
uuauaguauucuguaauccucac

SEQ ID NO: 2009 - RNA, 23 nt, Artificial sequence
  Synthetic oligonucletide
uuguuuucuuauaucuuauucuu

SEQ ID NO: 2010 - RNA, 23 nt, Artificial sequence
  Synthetic oligonucletide
aauaauuauuuaaagaguuuauu

SEQ ID NO: 2011 - RNA, 23 nt, Artificial sequence
  Synthetic oligonucletide
auucuacuuuauaauuugaguua

SEQ ID NO: 2012 - RNA, 23 nt, Artificial sequence
  Synthetic oligonucletide
cuuuacacuuuaugaugaagaau

SEQ ID NO: 2013 - RNA, 23 nt, Artificial sequence
  Synthetic oligonucletide
gcauuuuaaaauuguuuuuagug

SEQ ID NO: 2014 - RNA, 23 nt, Artificial sequence
  Synthetic oligonucletide
agaacuuauucuauaguagaaca

SEQ ID NO: 2015 - RNA, 23 nt, Artificial sequence
  Synthetic oligonucletide
cuguaaauuaagauaagaacuua

SEQ ID NO: 2016 - RNA, 23 nt, Artificial sequence
  Synthetic oligonucletide
gugcccuguaaauuaagauaaga

SEQ ID NO: 2017 - RNA, 23 nt, Artificial sequence
  Synthetic oligonucletide
acauauuugagcauuuaguauau

SEQ ID NO: 2018 - RNA, 23 nt, Artificial sequence
  Synthetic oligonucletide
uauuaaauuuuaaaaauaaauug

SEQ ID NO: 2019 - RNA, 23 nt, Artificial sequence
  Synthetic oligonucletide
aauauaaaaggcaacauuaagca

SEQ ID NO: 2020 - RNA, 23 nt, Artificial sequence
  Synthetic oligonucletide
uucaagaacauucauuuuaauau

SEQ ID NO: 2021 - RNA, 23 nt, Artificial sequence
  Synthetic oligonucletide
auauauucuuaaccaauuaaaau

SEQ ID NO: 2022 - RNA, 23 nt, Artificial sequence
  Synthetic oligonucletide
cugauuugcauuaaacaaauaua

SEQ ID NO: 2023 - RNA, 23 nt, Artificial sequence
  Synthetic oligonucletide
auuuuaauauagugauucugauu

SEQ ID NO: 2024 - RNA, 23 nt, Artificial sequence
  Synthetic oligonucletide
aaaaggcaacauuaagcauuuua

SEQ ID NO: 2025 - RNA, 21 nt, Artificial sequence
  Synthetic oligonucletide
caauacucuauacugugauga

SEQ ID NO: 2026 - RNA, 21 nt, Artificial sequence
  Synthetic oligonucletide
aaaacuccccagcuaaacacc

SEQ ID NO: 2027 - RNA, 21 nt, Artificial sequence
  Synthetic oligonucletide
aaacugggugacagagucaga

SEQ ID NO: 2028 - RNA, 21 nt, Artificial sequence
  Synthetic oligonucletide
aucacagcugccaaggcuacc

SEQ ID NO: 2029 - RNA, 21 nt, Artificial sequence
  Synthetic oligonucletide
ccguaagacuucauacaacac

SEQ ID NO: 2030 - RNA, 21 nt, Artificial sequence
  Synthetic oligonucletide
cuaaaagaagacaguuaucuc

SEQ ID NO: 2031 - RNA, 21 nt, Artificial sequence
  Synthetic oligonucletide
ccugcugguaucauggagaaa

SEQ ID NO: 2032 - RNA, 21 nt, Artificial sequence
  Synthetic oligonucletide
cauauuuggcugccagcuuuu

SEQ ID NO: 2033 - RNA, 21 nt, Artificial sequence
  Synthetic oligonucletide
uuaucuuucucucgaccacuu

SEQ ID NO: 2034 - RNA, 21 nt, Artificial sequence
  Synthetic oligonucletide
uaaaacuucagacuuccuguc

SEQ ID NO: 2035 - RNA, 21 nt, Artificial sequence
  Synthetic oligonucletide
cagcuauaagaagagccucaa

SEQ ID NO: 2036 - RNA, 21 nt, Artificial sequence
  Synthetic oligonucletide
aguccaauaccucacucgcuc

SEQ ID NO: 2037 - RNA, 21 nt, Artificial sequence
  Synthetic oligonucletide
accauugaaaugccucaacaa

SEQ ID NO: 2038 - RNA, 21 nt, Artificial sequence
  Synthetic oligonucletide
agcacgucaaaagcuacagaa

SEQ ID NO: 2039 - RNA, 21 nt, Artificial sequence
  Synthetic oligonucletide
ugcuucucugaaguucugcua

SEQ ID NO: 2040 - RNA, 21 nt, Artificial sequence
  Synthetic oligonucletide
gcugaucuguaucaucgugau

SEQ ID NO: 2041 - RNA, 21 nt, Artificial sequence
  Synthetic oligonucletide
aucuauuuaucaauuucuguc

SEQ ID NO: 2042 - RNA, 21 nt, Artificial sequence
  Synthetic oligonucletide
cucaucuuaauaugucucuug

SEQ ID NO: 2043 - RNA, 21 nt, Artificial sequence
  Synthetic oligonucletide
acaaccucuagaucugcagcu

SEQ ID NO: 2044 - RNA, 21 nt, Artificial sequence
  Synthetic oligonucletide
gaaaacaauauuguauaacag

SEQ ID NO: 2045 - RNA, 21 nt, Artificial sequence
  Synthetic oligonucletide
uugccacaucagcuuaaaauc

SEQ ID NO: 2046 - RNA, 21 nt, Artificial sequence
  Synthetic oligonucletide
cugucaucccaugcagacagg

SEQ ID NO: 2047 - RNA, 21 nt, Artificial sequence
  Synthetic oligonucletide
gaccacuuccugaguagaaga

SEQ ID NO: 2048 - RNA, 21 nt, Artificial sequence
  Synthetic oligonucletide
aguuucuuugugaaaagguca

SEQ ID NO: 2049 - RNA, 21 nt, Artificial sequence
  Synthetic oligonucletide
guauaaaaugcaacuguugau

SEQ ID NO: 2050 - RNA, 21 nt, Artificial sequence
  Synthetic oligonucletide
aaauuaacuucaaaauaagug

SEQ ID NO: 2051 - RNA, 21 nt, Artificial sequence
  Synthetic oligonucletide
aagauuaagacuaaaacuuau

SEQ ID NO: 2052 - RNA, 21 nt, Artificial sequence
  Synthetic oligonucletide
cuguuggaucuuguaaacaug

SEQ ID NO: 2053 - RNA, 21 nt, Artificial sequence
  Synthetic oligonucletide
uuguuaccauauguauucauc

SEQ ID NO: 2054 - RNA, 21 nt, Artificial sequence
  Synthetic oligonucletide
gaaaagggcuuuauuuucaaa

SEQ ID NO: 2055 - RNA, 21 nt, Artificial sequence
  Synthetic oligonucletide
ucugaagaugaagaguuuagu

SEQ ID NO: 2056 - RNA, 21 nt, Artificial sequence
  Synthetic oligonucletide
agcauuauuuuuacucuuuug

SEQ ID NO: 2057 - RNA, 21 nt, Artificial sequence
  Synthetic oligonucletide
uuuccucaacauggcucacaa

SEQ ID NO: 2058 - RNA, 21 nt, Artificial sequence
  Synthetic oligonucletide
uuuuaaaacugcacugccaac

SEQ ID NO: 2059 - RNA, 21 nt, Artificial sequence
  Synthetic oligonucletide
caaguucacuucauauauaaa

SEQ ID NO: 2060 - RNA, 21 nt, Artificial sequence
  Synthetic oligonucletide
aauuucuaucccaaaucuuuu

SEQ ID NO: 2061 - RNA, 21 nt, Artificial sequence
  Synthetic oligonucletide
ucuucaccaaguaucaaagua

SEQ ID NO: 2062 - RNA, 21 nt, Artificial sequence
  Synthetic oligonucletide
aauaacacaaaugaaguguca

SEQ ID NO: 2063 - RNA, 21 nt, Artificial sequence
  Synthetic oligonucletide
gaggugaauauaauuuauauu

SEQ ID NO: 2064 - RNA, 21 nt, Artificial sequence
  Synthetic oligonucletide
aauacuaaguauuuuucaggu

SEQ ID NO: 2065 - RNA, 21 nt, Artificial sequence
  Synthetic oligonucletide
uacaauguaaaagcuucuuua

SEQ ID NO: 2066 - RNA, 21 nt, Artificial sequence
  Synthetic oligonucletide
accaaguaucaaaguaauaac

SEQ ID NO: 2067 - RNA, 21 nt, Artificial sequence
  Synthetic oligonucletide
uaguaacuaucagaaucuaca

SEQ ID NO: 2068 - RNA, 21 nt, Artificial sequence
  Synthetic oligonucletide
auuauucaaaauaguccacug

SEQ ID NO: 2069 - RNA, 21 nt, Artificial sequence
  Synthetic oligonucletide
gacuccucacaucuguuaucu

SEQ ID NO: 2070 - RNA, 21 nt, Artificial sequence
  Synthetic oligonucletide
auucuaaaacagaaauuguau

SEQ ID NO: 2071 - RNA, 21 nt, Artificial sequence
  Synthetic oligonucletide
uuauuauaaagaacuauuugu

SEQ ID NO: 2072 - RNA, 21 nt, Artificial sequence
  Synthetic oligonucletide
uuuuuucuaugccacauuaac

SEQ ID NO: 2073 - RNA, 21 nt, Artificial sequence
  Synthetic oligonucletide
aaucaaguauggaaaaguaag

SEQ ID NO: 2074 - RNA, 21 nt, Artificial sequence
  Synthetic oligonucletide
ggccauacucuuacauaauaa

SEQ ID NO: 2075 - RNA, 21 nt, Artificial sequence
  Synthetic oligonucletide
caucuuuuaaaguugaugaga

SEQ ID NO: 2076 - RNA, 21 nt, Artificial sequence
  Synthetic oligonucletide
aguugaugagaaucaaguaug

SEQ ID NO: 2077 - RNA, 21 nt, Artificial sequence
  Synthetic oligonucletide
aaauuccuuuuaaguaauuuu

SEQ ID NO: 2078 - RNA, 21 nt, Artificial sequence
  Synthetic oligonucletide
uuucaaagaaucacagaauuc

SEQ ID NO: 2079 - RNA, 21 nt, Artificial sequence
  Synthetic oligonucletide
auaaaucuguucuaagacaua

SEQ ID NO: 2080 - RNA, 21 nt, Artificial sequence
  Synthetic oligonucletide
gagauuagucauaucacuaau

SEQ ID NO: 2081 - RNA, 21 nt, Artificial sequence
  Synthetic oligonucletide
ggugguuaauaugugacagug

SEQ ID NO: 2082 - RNA, 21 nt, Artificial sequence
  Synthetic oligonucletide
uauacuaacaacagaaucuaa

SEQ ID NO: 2083 - RNA, 21 nt, Artificial sequence
  Synthetic oligonucletide
augaucaacagaugagaacug

SEQ ID NO: 2084 - RNA, 21 nt, Artificial sequence
  Synthetic oligonucletide
cuaguacauguagguaaauca

SEQ ID NO: 2085 - RNA, 21 nt, Artificial sequence
  Synthetic oligonucletide
guuaccuagcuuaccauacua

SEQ ID NO: 2086 - RNA, 21 nt, Artificial sequence
  Synthetic oligonucletide
aucuucauuuaaggcacugua

SEQ ID NO: 2087 - RNA, 21 nt, Artificial sequence
  Synthetic oligonucletide
agugaauuaucugagcuagag

SEQ ID NO: 2088 - RNA, 21 nt, Artificial sequence
  Synthetic oligonucletide
ccuagcuuaccauacuauauc

SEQ ID NO: 2089 - RNA, 21 nt, Artificial sequence
  Synthetic oligonucletide
cauacuauaucuuuggaauca

SEQ ID NO: 2090 - RNA, 21 nt, Artificial sequence
  Synthetic oligonucletide
cuuaccauacuauaucuuugg

SEQ ID NO: 2091 - RNA, 21 nt, Artificial sequence
  Synthetic oligonucletide
ccagccuaacauccaaugcag

SEQ ID NO: 2092 - RNA, 21 nt, Artificial sequence
  Synthetic oligonucletide
auaucuuuggaaucaugaaac

SEQ ID NO: 2093 - RNA, 21 nt, Artificial sequence
  Synthetic oligonucletide
ggcaaggaaaauaaaagauuu

SEQ ID NO: 2094 - RNA, 21 nt, Artificial sequence
  Synthetic oligonucletide
uuugcagguugucuuccauuc

SEQ ID NO: 2095 - RNA, 21 nt, Artificial sequence
  Synthetic oligonucletide
uccagugacagaaaaauauau

SEQ ID NO: 2096 - RNA, 21 nt, Artificial sequence
  Synthetic oligonucletide
ccuuaagacuucagaaugauu

SEQ ID NO: 2097 - RNA, 21 nt, Artificial sequence
  Synthetic oligonucletide
uuaucucaaguauuuuuuaaa

SEQ ID NO: 2098 - RNA, 21 nt, Artificial sequence
  Synthetic oligonucletide
caaauauuaacuaauuauuag

SEQ ID NO: 2099 - RNA, 21 nt, Artificial sequence
  Synthetic oligonucletide
aaauauaugaauucucucucc

SEQ ID NO: 2100 - RNA, 21 nt, Artificial sequence
  Synthetic oligonucletide
uuguuggcccaucuauuacau

SEQ ID NO: 2101 - RNA, 21 nt, Artificial sequence
  Synthetic oligonucletide
ucuacagcugacccuugaaca

SEQ ID NO: 2102 - RNA, 21 nt, Artificial sequence
  Synthetic oligonucletide
gauuauauuuugaaaugaacu

SEQ ID NO: 2103 - RNA, 21 nt, Artificial sequence
  Synthetic oligonucletide
auggggguuaggggagcugac

SEQ ID NO: 2104 - RNA, 21 nt, Artificial sequence
  Synthetic oligonucletide
ggguccgcaaaaucuuaacua

SEQ ID NO: 2105 - RNA, 21 nt, Artificial sequence
  Synthetic oligonucletide
cugauaacauaaacaguaaau

SEQ ID NO: 2106 - RNA, 21 nt, Artificial sequence
  Synthetic oligonucletide
acuauugaccauaaaccuuac

SEQ ID NO: 2107 - RNA, 21 nt, Artificial sequence
  Synthetic oligonucletide
ucuuaacuaccuaauagccua

SEQ ID NO: 2108 - RNA, 21 nt, Artificial sequence
  Synthetic oligonucletide
caauucguggguccgcaaaau

SEQ ID NO: 2109 - RNA, 21 nt, Artificial sequence
  Synthetic oligonucletide
aaucauaagaaagagaaaaua

SEQ ID NO: 2110 - RNA, 21 nt, Artificial sequence
  Synthetic oligonucletide
uuccuacaauaaaguaagcua

SEQ ID NO: 2111 - RNA, 21 nt, Artificial sequence
  Synthetic oligonucletide
auauuuacuauucauuaaaug

SEQ ID NO: 2112 - RNA, 21 nt, Artificial sequence
  Synthetic oligonucletide
uuaacacauauuuugcguguu

SEQ ID NO: 2113 - RNA, 21 nt, Artificial sequence
  Synthetic oligonucletide
agagaaaauguuauuuagaaa

SEQ ID NO: 2114 - RNA, 21 nt, Artificial sequence
  Synthetic oligonucletide
uauauguauuauacacuauau

SEQ ID NO: 2115 - RNA, 21 nt, Artificial sequence
  Synthetic oligonucletide
cacauugaguaggcagaggag

SEQ ID NO: 2116 - RNA, 21 nt, Artificial sequence
  Synthetic oligonucletide
ucuugucuuaggggugugggg

SEQ ID NO: 2117 - RNA, 21 nt, Artificial sequence
  Synthetic oligonucletide
ggagaaagauggggaggaaga

SEQ ID NO: 2118 - RNA, 21 nt, Artificial sequence
  Synthetic oligonucletide
ggaagugggucaacauaaaag

SEQ ID NO: 2119 - RNA, 21 nt, Artificial sequence
  Synthetic oligonucletide
gucuucauucucauugucuuc

SEQ ID NO: 2120 - RNA, 21 nt, Artificial sequence
  Synthetic oligonucletide
agaaggcguuggucuugcagu

SEQ ID NO: 2121 - RNA, 21 nt, Artificial sequence
  Synthetic oligonucletide
gagugggggaaagaauauuca

SEQ ID NO: 2122 - RNA, 21 nt, Artificial sequence
  Synthetic oligonucletide
auguauaaguggacccuugca

SEQ ID NO: 2123 - RNA, 21 nt, Artificial sequence
  Synthetic oligonucletide
aagggucaacuguaauaggau

SEQ ID NO: 2124 - RNA, 21 nt, Artificial sequence
  Synthetic oligonucletide
uauagcuauuuuucuuccucu

SEQ ID NO: 2125 - RNA, 21 nt, Artificial sequence
  Synthetic oligonucletide
uaucaaccaaaugguaagcau

SEQ ID NO: 2126 - RNA, 21 nt, Artificial sequence
  Synthetic oligonucletide
aauucaagcccuuguuguuca

SEQ ID NO: 2127 - RNA, 21 nt, Artificial sequence
  Synthetic oligonucletide
auuuucuugaugaauaaauuu

SEQ ID NO: 2128 - RNA, 21 nt, Artificial sequence
  Synthetic oligonucletide
uuucagaacaucuuccaauaa

SEQ ID NO: 2129 - RNA, 21 nt, Artificial sequence
  Synthetic oligonucletide
acugagcuaaauuauagaucc

SEQ ID NO: 2130 - RNA, 21 nt, Artificial sequence
  Synthetic oligonucletide
cagcuaugcuauuuauaauua

SEQ ID NO: 2131 - RNA, 21 nt, Artificial sequence
  Synthetic oligonucletide
uucaauuucuccucugaccau

SEQ ID NO: 2132 - RNA, 21 nt, Artificial sequence
  Synthetic oligonucletide
ucuauuuugcaguccacucua

SEQ ID NO: 2133 - RNA, 21 nt, Artificial sequence
  Synthetic oligonucletide
auauucaccaaacuuugguaa

SEQ ID NO: 2134 - RNA, 21 nt, Artificial sequence
  Synthetic oligonucletide
uuacaccuauacugcauaauc

SEQ ID NO: 2135 - RNA, 21 nt, Artificial sequence
  Synthetic oligonucletide
aaaauugagugcuggaaaaua

SEQ ID NO: 2136 - RNA, 21 nt, Artificial sequence
  Synthetic oligonucletide
aaaauuaagucuaaaauaguu

SEQ ID NO: 2137 - RNA, 21 nt, Artificial sequence
  Synthetic oligonucletide
auuuaaguugacuaaaguuua

SEQ ID NO: 2138 - RNA, 21 nt, Artificial sequence
  Synthetic oligonucletide
acucauaaaacaacugaagua

SEQ ID NO: 2139 - RNA, 21 nt, Artificial sequence
  Synthetic oligonucletide
ccaacaauuuuaauuucaguu

SEQ ID NO: 2140 - RNA, 21 nt, Artificial sequence
  Synthetic oligonucletide
ugaagacauguuacuaauaua

SEQ ID NO: 2141 - RNA, 21 nt, Artificial sequence
  Synthetic oligonucletide
ucuucuaaaacaugguuacua

SEQ ID NO: 2142 - RNA, 21 nt, Artificial sequence
  Synthetic oligonucletide
aggauguguaauuaaccauau

SEQ ID NO: 2143 - RNA, 21 nt, Artificial sequence
  Synthetic oligonucletide
aaaagaauauguaacaucaau

SEQ ID NO: 2144 - RNA, 21 nt, Artificial sequence
  Synthetic oligonucletide
aacuauuauuaaaagaguaga

SEQ ID NO: 2145 - RNA, 21 nt, Artificial sequence
  Synthetic oligonucletide
aaaguguuugguucagggaua

SEQ ID NO: 2146 - RNA, 21 nt, Artificial sequence
  Synthetic oligonucletide
auuuucugaacccaugagaga

SEQ ID NO: 2147 - RNA, 21 nt, Artificial sequence
  Synthetic oligonucletide
acaaguguugcuaacucaaua

SEQ ID NO: 2148 - RNA, 21 nt, Artificial sequence
  Synthetic oligonucletide
uauugaccuugguuucuuaca

SEQ ID NO: 2149 - RNA, 21 nt, Artificial sequence
  Synthetic oligonucletide
ucaucuacaagcuggaaauuc

SEQ ID NO: 2150 - RNA, 21 nt, Artificial sequence
  Synthetic oligonucletide
agugaaggagacacuauuaaa

SEQ ID NO: 2151 - RNA, 21 nt, Artificial sequence
  Synthetic oligonucletide
auacuagagauggggagugga

SEQ ID NO: 2152 - RNA, 21 nt, Artificial sequence
  Synthetic oligonucletide
acucaccucacugguuuuagu

SEQ ID NO: 2153 - RNA, 21 nt, Artificial sequence
  Synthetic oligonucletide
gagauuucuuaagugacgccu

SEQ ID NO: 2154 - RNA, 21 nt, Artificial sequence
  Synthetic oligonucletide
uuauaaacaacaggugauaca

SEQ ID NO: 2155 - RNA, 21 nt, Artificial sequence
  Synthetic oligonucletide
aucugaagaacagaagggcag

SEQ ID NO: 2156 - RNA, 21 nt, Artificial sequence
  Synthetic oligonucletide
ccuaaaaacaaguagaaagcu

SEQ ID NO: 2157 - RNA, 21 nt, Artificial sequence
  Synthetic oligonucletide
uaaauuaccaauacagaaagu

SEQ ID NO: 2158 - RNA, 21 nt, Artificial sequence
  Synthetic oligonucletide
aguggaaaauuugaacugauu

SEQ ID NO: 2159 - RNA, 21 nt, Artificial sequence
  Synthetic oligonucletide
cacuguuuguuacaauauuuu

SEQ ID NO: 2160 - RNA, 21 nt, Artificial sequence
  Synthetic oligonucletide
uucucaguaaacagaaauaac

SEQ ID NO: 2161 - RNA, 21 nt, Artificial sequence
  Synthetic oligonucletide
uaucccuagucuuaaaaacaa

SEQ ID NO: 2162 - RNA, 21 nt, Artificial sequence
  Synthetic oligonucletide
uagucauauuccuuugauuac

SEQ ID NO: 2163 - RNA, 21 nt, Artificial sequence
  Synthetic oligonucletide
cuaauuuuuuuguucuucauu

SEQ ID NO: 2164 - RNA, 21 nt, Artificial sequence
  Synthetic oligonucletide
aaauaauuauucuucaucaua

SEQ ID NO: 2165 - RNA, 21 nt, Artificial sequence
  Synthetic oligonucletide
uaaaguagaauaaacucuuua

SEQ ID NO: 2166 - RNA, 21 nt, Artificial sequence
  Synthetic oligonucletide
ucuuugauagaaauuaaaauc

SEQ ID NO: 2167 - RNA, 21 nt, Artificial sequence
  Synthetic oligonucletide
gaauacuauaacucaaauuau

SEQ ID NO: 2168 - RNA, 21 nt, Artificial sequence
  Synthetic oligonucletide
cuuauucugugaggauuacag

SEQ ID NO: 2169 - RNA, 21 nt, Artificial sequence
  Synthetic oligonucletide
uuacagggcacuaaaaacaau

SEQ ID NO: 2170 - RNA, 21 nt, Artificial sequence
  Synthetic oligonucletide
cucaaauauguucuacuauag

SEQ ID NO: 2171 - RNA, 21 nt, Artificial sequence
  Synthetic oligonucletide
gaauaaguucuuaucuuaauu

SEQ ID NO: 2172 - RNA, 21 nt, Artificial sequence
  Synthetic oligonucletide
aaaguguaaagaauaagauau

SEQ ID NO: 2173 - RNA, 21 nt, Artificial sequence
  Synthetic oligonucletide
aaaauuuaauauacuaaaugc

SEQ ID NO: 2174 - RNA, 21 nt, Artificial sequence
  Synthetic oligonucletide
uaagaaaacaauuuauuuuua

SEQ ID NO: 2175 - RNA, 21 nt, Artificial sequence
  Synthetic oligonucletide
uaagaauauauauuuguuuaa

SEQ ID NO: 2176 - RNA, 21 nt, Artificial sequence
  Synthetic oligonucletide
augaauguucuugaaaacuca

SEQ ID NO: 2177 - RNA, 21 nt, Artificial sequence
  Synthetic oligonucletide
ccuuuuauauuuuaauugguu

SEQ ID NO: 2178 - RNA, 21 nt, Artificial sequence
  Synthetic oligonucletide
uuuuaaaaugcuuaauguugc

SEQ ID NO: 2179 - RNA, 21 nt, Artificial sequence
  Synthetic oligonucletide
ucacuauauuaaaaugaaugu

SEQ ID NO: 2180 - RNA, 21 nt, Artificial sequence
  Synthetic oligonucletide
augcaaaucagaaucacuaua

SEQ ID NO: 2181 - RNA, 21 nt, Artificial sequence
  Synthetic oligonucletide
ucauacaacacaauacucuau

SEQ ID NO: 2182 - RNA, 21 nt, Artificial sequence
  Synthetic oligonucletide
uacugugaugaucacagcugc

SEQ ID NO: 2183 - RNA, 21 nt, Artificial sequence
  Synthetic oligonucletide
agcuaaacacccguaagacuu

SEQ ID NO: 2184 - RNA, 21 nt, Artificial sequence
  Synthetic oligonucletide
acaguuaucucauauuuggcu

SEQ ID NO: 2185 - RNA, 21 nt, Artificial sequence
  Synthetic oligonucletide
ccaaggcuaccuaaaagaaga

SEQ ID NO: 2186 - RNA, 21 nt, Artificial sequence
  Synthetic oligonucletide
acagagucagaaaacucccca

SEQ ID NO: 2187 - RNA, 21 nt, Artificial sequence
  Synthetic oligonucletide
aagagccucaaccauugaaau

SEQ ID NO: 2188 - RNA, 21 nt, Artificial sequence
  Synthetic oligonucletide
cucgaccacuuaaaacuucag

SEQ ID NO: 2189 - RNA, 21 nt, Artificial sequence
  Synthetic oligonucletide
gacuuccuguccugcugguau

SEQ ID NO: 2190 - RNA, 21 nt, Artificial sequence
  Synthetic oligonucletide
ugccagcuuuuuaucuuucuc

SEQ ID NO: 2191 - RNA, 21 nt, Artificial sequence
  Synthetic oligonucletide
ucauggagaaaguccaauacc

SEQ ID NO: 2192 - RNA, 21 nt, Artificial sequence
  Synthetic oligonucletide
cucacucgcucagcuauaaga

SEQ ID NO: 2193 - RNA, 21 nt, Artificial sequence
  Synthetic oligonucletide
caauuucugucucaucuuaau

SEQ ID NO: 2194 - RNA, 21 nt, Artificial sequence
  Synthetic oligonucletide
uaugucucuugcugaucugua

SEQ ID NO: 2195 - RNA, 21 nt, Artificial sequence
  Synthetic oligonucletide
ugccucaacaagcacgucaaa

SEQ ID NO: 2196 - RNA, 21 nt, Artificial sequence
  Synthetic oligonucletide
aaguucugcuacaaccucuag

SEQ ID NO: 2197 - RNA, 21 nt, Artificial sequence
  Synthetic oligonucletide
aucaucgugaugcuucucuga

SEQ ID NO: 2198 - RNA, 21 nt, Artificial sequence
  Synthetic oligonucletide
aagcuacagaaucuauuuauc

SEQ ID NO: 2199 - RNA, 21 nt, Artificial sequence
  Synthetic oligonucletide
ugaguagaagaguuucuuugu

SEQ ID NO: 2200 - RNA, 21 nt, Artificial sequence
  Synthetic oligonucletide
gaucugcagcuugccacauca

SEQ ID NO: 2201 - RNA, 21 nt, Artificial sequence
  Synthetic oligonucletide
ugaaaaggucaagauuaagac

SEQ ID NO: 2202 - RNA, 21 nt, Artificial sequence
  Synthetic oligonucletide
augcagacaggaaaacaauau

SEQ ID NO: 2203 - RNA, 21 nt, Artificial sequence
  Synthetic oligonucletide
uuguauaacagaccacuuccu

SEQ ID NO: 2204 - RNA, 21 nt, Artificial sequence
  Synthetic oligonucletide
agcuuaaaaucugucauccca

SEQ ID NO: 2205 - RNA, 21 nt, Artificial sequence
  Synthetic oligonucletide
cuaaaacuuauuguuaccaua

SEQ ID NO: 2206 - RNA, 21 nt, Artificial sequence
  Synthetic oligonucletide
caaaauaaguguauaaaaugc

SEQ ID NO: 2207 - RNA, 21 nt, Artificial sequence
  Synthetic oligonucletide
auguauucaucuguuggaucu

SEQ ID NO: 2208 - RNA, 21 nt, Artificial sequence
  Synthetic oligonucletide
uuguaaacaugaaaagggcuu

SEQ ID NO: 2209 - RNA, 21 nt, Artificial sequence
  Synthetic oligonucletide
uuauuuucaaaaauuaacuuc

SEQ ID NO: 2210 - RNA, 21 nt, Artificial sequence
  Synthetic oligonucletide
caacuguugauuuccucaaca

SEQ ID NO: 2211 - RNA, 21 nt, Artificial sequence
  Synthetic oligonucletide
gcacugccaacaaguucacuu

SEQ ID NO: 2212 - RNA, 21 nt, Artificial sequence
  Synthetic oligonucletide
aagaguuuaguuuuaaaacug

SEQ ID NO: 2213 - RNA, 21 nt, Artificial sequence
  Synthetic oligonucletide
ucauauauaaagcauuauuuu

SEQ ID NO: 2214 - RNA, 21 nt, Artificial sequence
  Synthetic oligonucletide
uuacucuuuugaggugaauau

SEQ ID NO: 2215 - RNA, 21 nt, Artificial sequence
  Synthetic oligonucletide
auggcucacaaauuucuaucc

SEQ ID NO: 2216 - RNA, 21 nt, Artificial sequence
  Synthetic oligonucletide
ccaaaucuuuucugaagauga

SEQ ID NO: 2217 - RNA, 21 nt, Artificial sequence
  Synthetic oligonucletide
aagcuucuuuaauacuaagua

SEQ ID NO: 2218 - RNA, 21 nt, Artificial sequence
  Synthetic oligonucletide
augaagugucauuauucaaaa

SEQ ID NO: 2219 - RNA, 21 nt, Artificial sequence
  Synthetic oligonucletide
auaguccacugacuccucaca

SEQ ID NO: 2220 - RNA, 21 nt, Artificial sequence
  Synthetic oligonucletide
auuuuucaggucuucaccaag

SEQ ID NO: 2221 - RNA, 21 nt, Artificial sequence
  Synthetic oligonucletide
aucuguuaucuuauuauaaag

SEQ ID NO: 2222 - RNA, 21 nt, Artificial sequence
  Synthetic oligonucletide
uaauuuauauuacaauguaaa

SEQ ID NO: 2223 - RNA, 21 nt, Artificial sequence
  Synthetic oligonucletide
agaaauuguauuuuuucuaug

SEQ ID NO: 2224 - RNA, 21 nt, Artificial sequence
  Synthetic oligonucletide
cagaaucuacauucuaaaaca

SEQ ID NO: 2225 - RNA, 21 nt, Artificial sequence
  Synthetic oligonucletide
gccacauuaacaucuuuuaaa

SEQ ID NO: 2226 - RNA, 21 nt, Artificial sequence
  Synthetic oligonucletide
ggaaaaguaaggccauacucu

SEQ ID NO: 2227 - RNA, 21 nt, Artificial sequence
  Synthetic oligonucletide
gaacuauuuguaguaacuauc

SEQ ID NO: 2228 - RNA, 21 nt, Artificial sequence
  Synthetic oligonucletide
uuacauaauaaaauuccuuuu

SEQ ID NO: 2229 - RNA, 21 nt, Artificial sequence
  Synthetic oligonucletide
uagguaaaucauaaaucuguu

SEQ ID NO: 2230 - RNA, 21 nt, Artificial sequence
  Synthetic oligonucletide
gaugagaacuggugguuaaua

SEQ ID NO: 2231 - RNA, 21 nt, Artificial sequence
  Synthetic oligonucletide
uaaguaauuuuuucaaagaau

SEQ ID NO: 2232 - RNA, 21 nt, Artificial sequence
  Synthetic oligonucletide
ucuaagacauaugaucaacag

SEQ ID NO: 2233 - RNA, 21 nt, Artificial sequence
  Synthetic oligonucletide
augugacagugagauuaguca

SEQ ID NO: 2234 - RNA, 21 nt, Artificial sequence
  Synthetic oligonucletide
ucacagaauucuaguacaugu

SEQ ID NO: 2235 - RNA, 21 nt, Artificial sequence
  Synthetic oligonucletide
aaucaugaaaccuuaagacuu

SEQ ID NO: 2236 - RNA, 21 nt, Artificial sequence
  Synthetic oligonucletide
aaggcacuguagugaauuauc

SEQ ID NO: 2237 - RNA, 21 nt, Artificial sequence
  Synthetic oligonucletide
acagaaucuaaucuucauuua

SEQ ID NO: 2238 - RNA, 21 nt, Artificial sequence
  Synthetic oligonucletide
cugagcuagaguuaccuagcu

SEQ ID NO: 2239 - RNA, 21 nt, Artificial sequence
  Synthetic oligonucletide
agacuucagaaugauuuugca

SEQ ID NO: 2240 - RNA, 21 nt, Artificial sequence
  Synthetic oligonucletide
auaucacuaauauacuaacaa

SEQ ID NO: 2241 - RNA, 21 nt, Artificial sequence
  Synthetic oligonucletide
auccaaugcaggcaaggaaaa

SEQ ID NO: 2242 - RNA, 21 nt, Artificial sequence
  Synthetic oligonucletide
uauuuuuuaaaaauauaugaa

SEQ ID NO: 2243 - RNA, 21 nt, Artificial sequence
  Synthetic oligonucletide
gucuuccauuccagccuaaca

SEQ ID NO: 2244 - RNA, 21 nt, Artificial sequence
  Synthetic oligonucletide
ucagaaugauuuugcagguug

SEQ ID NO: 2245 - RNA, 21 nt, Artificial sequence
  Synthetic oligonucletide
gaaaaauauauuaucucaagu

SEQ ID NO: 2246 - RNA, 21 nt, Artificial sequence
  Synthetic oligonucletide
auaaaagauuuccagugacag

SEQ ID NO: 2247 - RNA, 21 nt, Artificial sequence
  Synthetic oligonucletide
ugaaaugaacuuguuggccca

SEQ ID NO: 2248 - RNA, 21 nt, Artificial sequence
  Synthetic oligonucletide
auucucucuccaaauauuaac

SEQ ID NO: 2249 - RNA, 21 nt, Artificial sequence
  Synthetic oligonucletide
acccuugaacauggggguuag

SEQ ID NO: 2250 - RNA, 21 nt, Artificial sequence
  Synthetic oligonucletide
cuaauuauuagauuauauuuu

SEQ ID NO: 2251 - RNA, 21 nt, Artificial sequence
  Synthetic oligonucletide
gguuaggggagcugacaauuc

SEQ ID NO: 2252 - RNA, 21 nt, Artificial sequence
  Synthetic oligonucletide
aucuauuacaucuacagcuga

SEQ ID NO: 2253 - RNA, 21 nt, Artificial sequence
  Synthetic oligonucletide
uuuugcguguuauauguauua

SEQ ID NO: 2254 - RNA, 21 nt, Artificial sequence
  Synthetic oligonucletide
aaacaguaaauuaacacauau

SEQ ID NO: 2255 - RNA, 21 nt, Artificial sequence
  Synthetic oligonucletide
auacacuauauuccuacaaua

SEQ ID NO: 2256 - RNA, 21 nt, Artificial sequence
  Synthetic oligonucletide
auaaaccuuacugauaacaua

SEQ ID NO: 2257 - RNA, 21 nt, Artificial sequence
  Synthetic oligonucletide
ggggagcugacaauucguggg

SEQ ID NO: 2258 - RNA, 21 nt, Artificial sequence
  Synthetic oligonucletide
cuaauagccuacuauugacca

SEQ ID NO: 2259 - RNA, 21 nt, Artificial sequence
  Synthetic oligonucletide
caacauaaaagucuucauucu

SEQ ID NO: 2260 - RNA, 21 nt, Artificial sequence
  Synthetic oligonucletide
aagagaaaauauauuuacuau

SEQ ID NO: 2261 - RNA, 21 nt, Artificial sequence
  Synthetic oligonucletide
uuauuuagaaaaucauaagaa

SEQ ID NO: 2262 - RNA, 21 nt, Artificial sequence
  Synthetic oligonucletide
uucauuaaauggaaguggguc

SEQ ID NO: 2263 - RNA, 21 nt, Artificial sequence
  Synthetic oligonucletide
ucauugucuucacauugagua

SEQ ID NO: 2264 - RNA, 21 nt, Artificial sequence
  Synthetic oligonucletide
aaaguaagcuagagaaaaugu

SEQ ID NO: 2265 - RNA, 21 nt, Artificial sequence
  Synthetic oligonucletide
ggacccuugcaauucaagccc

SEQ ID NO: 2266 - RNA, 21 nt, Artificial sequence
  Synthetic oligonucletide
aggcagaggaggagaaagaug

SEQ ID NO: 2267 - RNA, 21 nt, Artificial sequence
  Synthetic oligonucletide
ggucuugcagucuugucuuag

SEQ ID NO: 2268 - RNA, 21 nt, Artificial sequence
  Synthetic oligonucletide
gggguguggggagugggggaa

SEQ ID NO: 2269 - RNA, 21 nt, Artificial sequence
  Synthetic oligonucletide
aagaauauucauguauaagug

SEQ ID NO: 2270 - RNA, 21 nt, Artificial sequence
  Synthetic oligonucletide
ggggaggaagagaaggcguug

SEQ ID NO: 2271 - RNA, 21 nt, Artificial sequence
  Synthetic oligonucletide
cuuguuguucaagggucaacu

SEQ ID NO: 2272 - RNA, 21 nt, Artificial sequence
  Synthetic oligonucletide
aguccacucuacugagcuaaa

SEQ ID NO: 2273 - RNA, 21 nt, Artificial sequence
  Synthetic oligonucletide
auuauagauccagcuaugcua

SEQ ID NO: 2274 - RNA, 21 nt, Artificial sequence
  Synthetic oligonucletide
uguaauaggauauagcuauuu

SEQ ID NO: 2275 - RNA, 21 nt, Artificial sequence
  Synthetic oligonucletide
uuucuuccucuaucaaccaaa

SEQ ID NO: 2276 - RNA, 21 nt, Artificial sequence
  Synthetic oligonucletide
augguaagcaucuauuuugca

SEQ ID NO: 2277 - RNA, 21 nt, Artificial sequence
  Synthetic oligonucletide
caacugaaguaaaauugagug

SEQ ID NO: 2278 - RNA, 21 nt, Artificial sequence
  Synthetic oligonucletide
ccucugaccauuucagaacau

SEQ ID NO: 2279 - RNA, 21 nt, Artificial sequence
  Synthetic oligonucletide
ucuuccaauaacucauaaaac

SEQ ID NO: 2280 - RNA, 21 nt, Artificial sequence
  Synthetic oligonucletide
auuuauaauuauuuucuugau

SEQ ID NO: 2281 - RNA, 21 nt, Artificial sequence
  Synthetic oligonucletide
cuugaugaauaaauuuucaau

SEQ ID NO: 2282 - RNA, 21 nt, Artificial sequence
  Synthetic oligonucletide
ugaauaaauuuucaauuucuc

SEQ ID NO: 2283 - RNA, 21 nt, Artificial sequence
  Synthetic oligonucletide
uaauuucaguugaagacaugu

SEQ ID NO: 2284 - RNA, 21 nt, Artificial sequence
  Synthetic oligonucletide
acugcauaauccaacaauuuu

SEQ ID NO: 2285 - RNA, 21 nt, Artificial sequence
  Synthetic oligonucletide
aacuuugguaauuuaaguuga

SEQ ID NO: 2286 - RNA, 21 nt, Artificial sequence
  Synthetic oligonucletide
acuaaaguuuaaaauuaaguc

SEQ ID NO: 2287 - RNA, 21 nt, Artificial sequence
  Synthetic oligonucletide
cuaaaauaguuuacaccuaua

SEQ ID NO: 2288 - RNA, 21 nt, Artificial sequence
  Synthetic oligonucletide
gcuggaaaauauauucaccaa

SEQ ID NO: 2289 - RNA, 21 nt, Artificial sequence
  Synthetic oligonucletide
guaacaucaauauugaccuug

SEQ ID NO: 2290 - RNA, 21 nt, Artificial sequence
  Synthetic oligonucletide
caugguuacuaaaagaauaug

SEQ ID NO: 2291 - RNA, 21 nt, Artificial sequence
  Synthetic oligonucletide
auuaaccauaucuucuaaaac

SEQ ID NO: 2292 - RNA, 21 nt, Artificial sequence
  Synthetic oligonucletide
acauguuacuaauauaacuau

SEQ ID NO: 2293 - RNA, 21 nt, Artificial sequence
  Synthetic oligonucletide
aaaagaguagaggauguguaa

SEQ ID NO: 2294 - RNA, 21 nt, Artificial sequence
  Synthetic oligonucletide
uuacuaauauaacuauuauua

SEQ ID NO: 2295 - RNA, 21 nt, Artificial sequence
  Synthetic oligonucletide
cccaugagagauacuagagau

SEQ ID NO: 2296 - RNA, 21 nt, Artificial sequence
  Synthetic oligonucletide
cugaacccaugagagauacua

SEQ ID NO: 2297 - RNA, 21 nt, Artificial sequence
  Synthetic oligonucletide
cuaacucaauagugaaggaga

SEQ ID NO: 2298 - RNA, 21 nt, Artificial sequence
  Synthetic oligonucletide
uggggaguggaaaguguuugg

SEQ ID NO: 2299 - RNA, 21 nt, Artificial sequence
  Synthetic oligonucletide
acacuauuaaauuuucugaac

SEQ ID NO: 2300 - RNA, 21 nt, Artificial sequence
  Synthetic oligonucletide
gguuucuuacacaaguguugc

SEQ ID NO: 2301 - RNA, 21 nt, Artificial sequence
  Synthetic oligonucletide
gcuggaaauuccuaaaaacaa

SEQ ID NO: 2302 - RNA, 21 nt, Artificial sequence
  Synthetic oligonucletide
aagugacgccucaucuacaag

SEQ ID NO: 2303 - RNA, 21 nt, Artificial sequence
  Synthetic oligonucletide
cagaagggcagagauuucuua

SEQ ID NO: 2304 - RNA, 21 nt, Artificial sequence
  Synthetic oligonucletide
uacaagcuggaaauuccuaaa

SEQ ID NO: 2305 - RNA, 21 nt, Artificial sequence
  Synthetic oligonucletide
guucagggauaucugaagaac

SEQ ID NO: 2306 - RNA, 21 nt, Artificial sequence
  Synthetic oligonucletide
aguagaaagcuuauaaacaac

SEQ ID NO: 2307 - RNA, 21 nt, Artificial sequence
  Synthetic oligonucletide
uugaacugauuagucauauuc

SEQ ID NO: 2308 - RNA, 21 nt, Artificial sequence
  Synthetic oligonucletide
auacagaaaguaucccuaguc

SEQ ID NO: 2309 - RNA, 21 nt, Artificial sequence
  Synthetic oligonucletide
auauuccuuugauuacacugu

SEQ ID NO: 2310 - RNA, 21 nt, Artificial sequence
  Synthetic oligonucletide
cugguuuuaguaaauuaccaa

SEQ ID NO: 2311 - RNA, 21 nt, Artificial sequence
  Synthetic oligonucletide
caggugauacacucaccucac

SEQ ID NO: 2312 - RNA, 21 nt, Artificial sequence
  Synthetic oligonucletide
cuuaaaaacaaguggaaaauu

SEQ ID NO: 2313 - RNA, 21 nt, Artificial sequence
  Synthetic oligonucletide
uacaauauuuuucucaguaaa

SEQ ID NO: 2314 - RNA, 21 nt, Artificial sequence
  Synthetic oligonucletide
ccuuugauuacacuguuuguu

SEQ ID NO: 2315 - RNA, 21 nt, Artificial sequence
  Synthetic oligonucletide
uguucuucauucuuugauaga

SEQ ID NO: 2316 - RNA, 21 nt, Artificial sequence
  Synthetic oligonucletide
gauagaaauuaaaaucuuauu

SEQ ID NO: 2317 - RNA, 21 nt, Artificial sequence
  Synthetic oligonucletide
acagaaauaacuaauuuuuuu

SEQ ID NO: 2318 - RNA, 21 nt, Artificial sequence
  Synthetic oligonucletide
aaauuaaaaucuuauucugug

SEQ ID NO: 2319 - RNA, 21 nt, Artificial sequence
  Synthetic oligonucletide
uagaauaaacucuuuaaauaa

SEQ ID NO: 2320 - RNA, 21 nt, Artificial sequence
  Synthetic oligonucletide
gaggauuacagaauacuauaa

SEQ ID NO: 2321 - RNA, 21 nt, Artificial sequence
  Synthetic oligonucletide
gaauaagauauaagaaaacaa

SEQ ID NO: 2322 - RNA, 21 nt, Artificial sequence
  Synthetic oligonucletide
uaaacucuuuaaauaauuauu

SEQ ID NO: 2323 - RNA, 21 nt, Artificial sequence
  Synthetic oligonucletide
acucaaauuauaaaguagaau

SEQ ID NO: 2324 - RNA, 21 nt, Artificial sequence
  Synthetic oligonucletide
ucuucaucauaaaguguaaag

SEQ ID NO: 2325 - RNA, 21 nt, Artificial sequence
  Synthetic oligonucletide
cuaaaaacaauuuuaaaaugc

SEQ ID NO: 2326 - RNA, 21 nt, Artificial sequence
  Synthetic oligonucletide
uucuacuauagaauaaguucu

SEQ ID NO: 2327 - RNA, 21 nt, Artificial sequence
  Synthetic oligonucletide
aguucuuaucuuaauuuacag

SEQ ID NO: 2328 - RNA, 21 nt, Artificial sequence
  Synthetic oligonucletide
uuaucuuaauuuacagggcac

SEQ ID NO: 2329 - RNA, 21 nt, Artificial sequence
  Synthetic oligonucletide
auacuaaaugcucaaauaugu

SEQ ID NO: 2330 - RNA, 21 nt, Artificial sequence
  Synthetic oligonucletide
auuuauuuuuaaaauuuaaua

SEQ ID NO: 2331 - RNA, 21 nt, Artificial sequence
  Synthetic oligonucletide
cuuaauguugccuuuuauauu

SEQ ID NO: 2332 - RNA, 21 nt, Artificial sequence
  Synthetic oligonucletide
auuaaaaugaauguucuugaa

SEQ ID NO: 2333 - RNA, 21 nt, Artificial sequence
  Synthetic oligonucletide
uuuaauugguuaagaauauau

SEQ ID NO: 2334 - RNA, 21 nt, Artificial sequence
  Synthetic oligonucletide
uauuuguuuaaugcaaaucag

SEQ ID NO: 2335 - RNA, 21 nt, Artificial sequence
  Synthetic oligonucletide
ucagaaucacuauauuaaaau

SEQ ID NO: 2336 - RNA, 21 nt, Artificial sequence
  Synthetic oligonucletide
aaaugcuuaauguugccuuuu

The invention claimed is:

1. An oligomeric compound comprising a modified oligonucleotide according to the following chemical notation: $A_{ks}{}^{m}C_{ks}G_{ds}A_{ds}G_{ds}T_{ds}A_{ds}T_{ds}A_{ds}T_{ds}T_{ds}A_{ks}G_{es}G_{ks}A_{es}A_{k}$ (SEQ ID NO: 737), wherein:

A=an adenine nucleobase, $^{m}$C=a 5-methyl cytosine nucleobase,

G=a guanine nucleobase,

T=a thymine nucleobase, e=a 2'-MOE sugar moiety, k=a cEt modified sugar moiety d=a 2'-β-D-deoxyribosyl sugar moiety, and s=a phosphorothioate internucleoside linkage.

2. A modified oligonucleotide according to the following chemical structure:

(SEQ ID NO: 737)

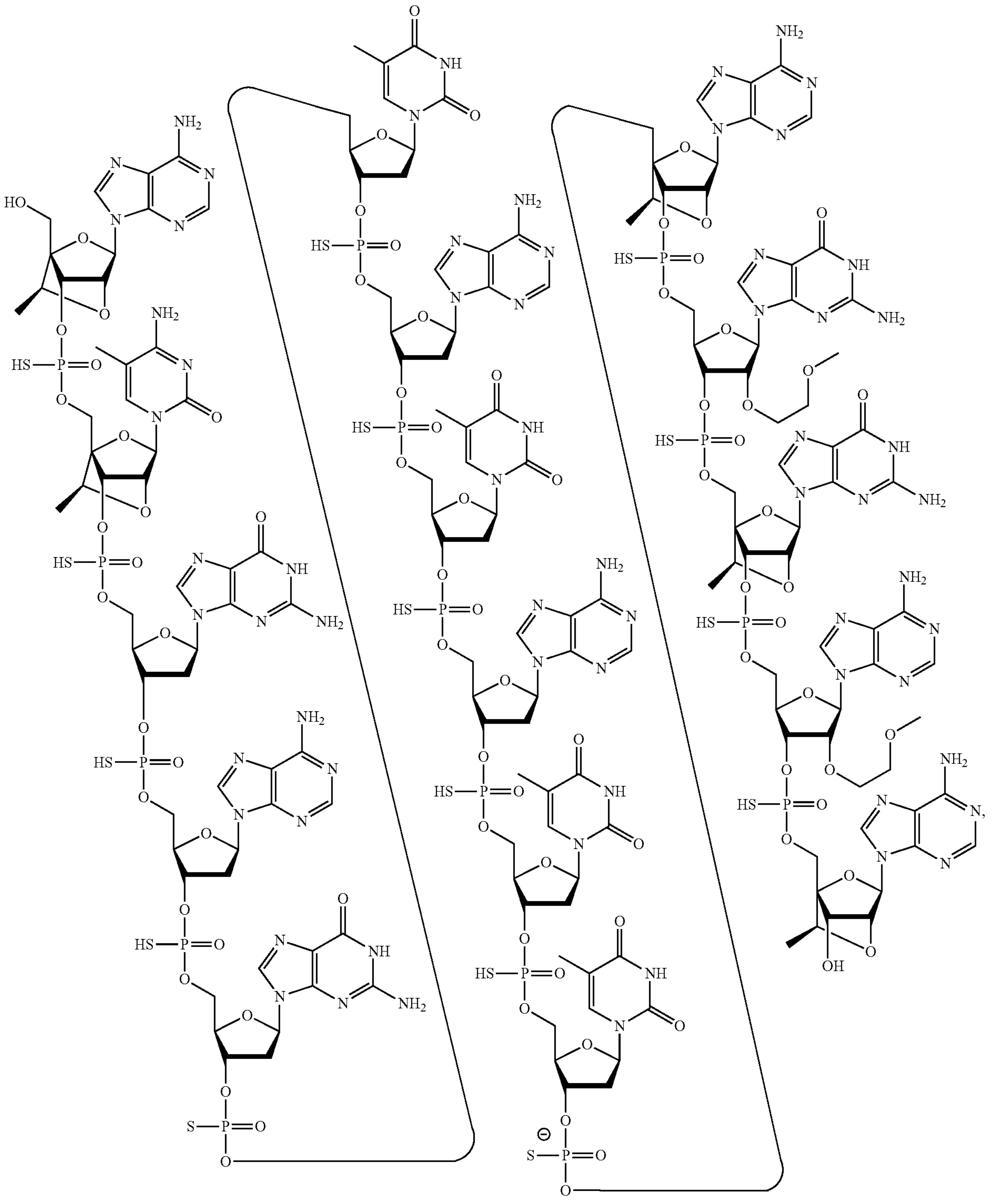

or a pharmaceutically acceptable salt thereof.

3. A pharmaceutically acceptable salt of a modified oligonucleotide according to the following chemical structure:

(SEQ ID NO: 737)

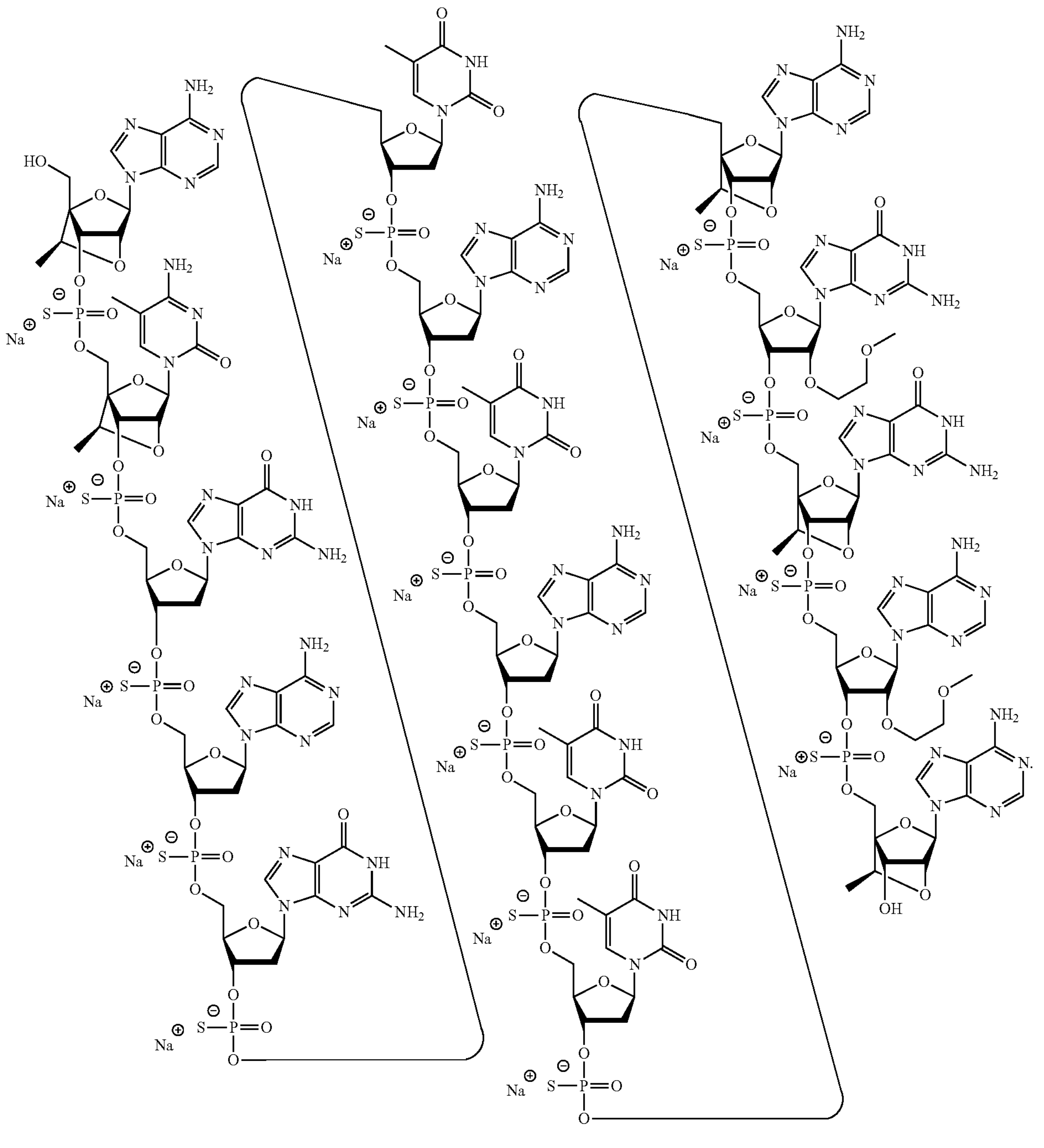

4. The oligomeric compound of claim 1, wherein the oligomeric compound comprises a conjugate group.

5. The oligomeric compound of claim 4, wherein the conjugate group comprises a C22 alkyl, C20 alkyl, C16 alkyl, C10 alkyl, C21 alkyl, C19 alkyl, C18 alkyl, C15 alkyl, C14 alkyl, C13 alkyl, C12 alkyl, C11 alkyl, C9 alkyl, C8 alkyl, C7 alkyl, C6 alkyl, C5 alkyl, C22 alkenyl, C20 alkenyl, C16 alkenyl, C10 alkenyl, C21 alkenyl, C19 alkenyl, C18 alkenyl, C15 alkenyl, C14 alkenyl, C13 alkenyl, C12 alkenyl, C11 alkenyl, C9 alkenyl, C8 alkenyl, C7 alkenyl, C6 alkenyl, or C5 alkenyl.

6. The oligomeric compound of claim 4, wherein the conjugate group has the following structure:

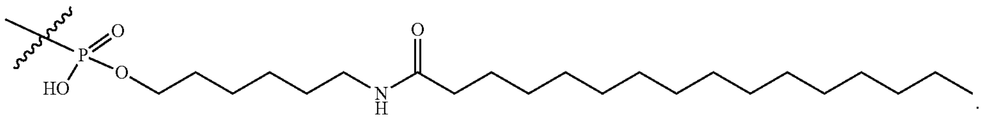

7. A method of treating a disease associated with PLN comprising administering to a subject having a disease associated with PLN a therapeutically effective amount of the oligomeric compound of claim 1.

8. The method of claim 7, wherein the disease associated with PLN is cardiomyopathy, heart failure, or arrhythmia.

9. The method of claim 8, wherein the cardiomyopathy is genetic cardiomyopathy.

10. The method of claim 9, wherein the genetic cardiomyopathy is associated with p.Arg14del, Arg9Cys (R9C), or Arg25Cys (R25C) genetic mutations.

11. The method of claim 8, wherein the cardiomyopathy is dilated cardiomyopathy (DCM).

12. The method of claim 11, wherein the DCM is genetic DCM.

13. The method of claim 12, wherein the genetic DCM is associated with TTN, LMNA, RBM20, SCN5A, MYH7, TNNT2, and TPM1 mutations.

14. The method of claim 11, wherein the DCM is arrhythmogenic DCM.

15. The method of claim 8, wherein the heart failure is heart failure with preserved ejection fraction (HFpEF), heart failure with reduced ejection fraction (HFrEF), acute heart failure, or worsening of chronic heart failure.

16. The method of claim 8, wherein the arrhythmia is ventricular tachycardia (Vtac) or ventricular fibrillation (Vfib).

17. The method of claim 7, wherein administering the oligomeric compound improves cardiac function, cardiovascular death, cardiac dilation, cardiac fibrosis, low voltage ECG, diastolic calcium uptake, ejection fraction (EF), left ventricular ejection fraction (LVEF), left ventricular end systolic volume (LVESV), left ventricular end diastolic volume (LVEDV), mitral valve flow profile, left ventricle (LV) strain, left ventricle (LV) strain rate, infarct size, heart failure hospitalization, 6 minute walk test (6MWT), the Kansas City Cardiomyopathy Questionnaire Score (KCCQS), heart rate, or heart rhythm in the subject.

18. A method of reducing expression of PLN in a cell comprising contacting the cell with the oligomeric compound of claim 1.

19. The method of claim 18, wherein the cell is a heart cell.

* * * * *